(12) United States Patent
Chien

(10) Patent No.: US 6,346,375 B1
(45) Date of Patent: Feb. 12, 2002

(54) NANBV DIAGNOSTICS AND VACCINES

(75) Inventor: David Y. Chien, Alamo, CA (US)

(73) Assignee: Chiron Corporation, Emeryville, CA (US)

(*) Notice: Subject to any disclaimer, the term of this patent is extended or adjusted under 35 U.S.C. 154(b) by 0 days.

(21) Appl. No.: 08/403,590

(22) Filed: Mar. 14, 1995

Related U.S. Application Data

(63) Continuation of application No. 07/722,489, filed on Jun. 24, 1991.

(51) Int. Cl.$^7$ .......................... C12Q 1/70; C07K 14/18
(52) U.S. Cl. ................ 435/5; 424/189.1; 424/228.1; 530/324; 530/325; 530/326; 530/327; 530/350
(58) Field of Search .................... 530/324–329, 530/350; 435/5; 424/189.1, 228.1

(56) References Cited

U.S. PATENT DOCUMENTS

| | | | |
|---|---|---|---|
| 4,861,588 A | * 8/1989 | Neurath et al. | |
| 5,312,737 A | 5/1994 | Bolling et al. | 435/69.1 |
| 5,350,671 A | * 9/1994 | Houghton et al. | 435/5 |
| 5,371,017 A | 12/1994 | Houghton et al. | 435/320.1 |
| 5,372,928 A | 12/1994 | Miyamura et al. | 435/5 |
| 5,443,965 A | * 8/1995 | Reyes et al. | 435/69.3 |

FOREIGN PATENT DOCUMENTS

| | | | |
|---|---|---|---|
| EP | 0318216 | * 5/1989 | |
| EP | 0 388 232 A1 | 3/1990 | C12N/15/51 |
| EP | 0 419 182 A1 | 3/1991 | C12N/15/07 |
| EP | 0 435 229 A1 | 7/1991 | C07K/15/00 |
| EP | 0 463 848 A2 | 1/1992 | C12N/15/40 |
| EP | 0 464 287 | 1/1992 | C12N/15/40 |
| EP | 0 468 527 A2 | 1/1992 | C07K/7/10 |
| EP | 0 468 657 A2 | 1/1992 | C12N/15/40 |
| EP | 0 472 207 A2 | 2/1992 | C12N/15/62 |
| EP | 0 475 182 A2 | 3/1992 | C12N/15/51 |
| EP | 0 484 787 A2 | 5/1992 | C07K/7/08 |
| EP | 0 485 209 A1 | 5/1992 | C12N/15/40 |
| EP | 0 489 968 A1 | 6/1992 | C07K/7/10 |
| EP | 0 507 615 A1 | 10/1992 | C07K/15/00 |
| EP | 0 518 313 A2 | 12/1992 | C12N/15/51 |
| EP | 0 521 318 | 1/1993 | C12N/15/51 |
| EP | 0 442 394 A2 | 8/1994 | C07K/7/08 |
| EP | 0 644 202 A1 | 3/1995 | C07K/14/18 |
| EP | 0 445 423 B1 | 9/1995 | G01N/33/576 |
| GB | 2 239 245 | 6/1991 | C12N/15/51 |
| GB | 2212511 | 1/1992 | C12N/7/00 |
| JP | 5 068 562 | of 0000 | |
| JP | 3-103180 | 4/1991 | C12N/15/51 |
| JP | 3-190898 | 8/1991 | C07K/7/10 |
| JP | 4-004880 | 1/1992 | C12N/15/51 |
| JP | 4-046196 | 2/1992 | C07K/13/00 |
| JP | 4-121193 | 4/1992 | C12N/15/62 |
| JP | 4-126086 | 4/1992 | C12N/15/51 |
| JP | 4-144686 | 5/1992 | C12N/15/51 |
| JP | 4-159298 | 6/1992 | C07K/7/08 |
| JP | 4-179482 | 6/1992 | C12N/15/51 |
| JP | 4-187090 | 7/1992 | C12N/15/51 |
| JP | 4-305156 | 10/1992 | G01N/33/576 |
| JP | 4-356500 | 12/1992 | C07K/13/00 |
| JP | 5-91884 | 4/1993 | C12N/15/51 |
| WO | 91/01376 | 2/1991 | |
| WO | 91/15516 | 10/1991 | C07K/15/00 |
| WO | 92/02642 | 2/1992 | C12Q/1/70 |
| WO | 92/03458 | 3/1992 | C07H/15/12 |
| WO | 92/09634 | 6/1992 | C07K/15/04 |
| WO | 92/13892 | 8/1992 | C07K/15/28 |
| WO | 92/21759 | 12/1992 | C12N/15/51 |
| WO | 92/22571 | 12/1992 | C07K/7/00 |

OTHER PUBLICATIONS

Kumar et al. PNAS 87: 1337–41 Feb. 1990.*
Hopp and Woods PNAS 78: 3824–3829 1981.*
Choo et al. Science 244:359–362 Apr. 21, 1989.*
Takahashi et al. Science 246: 118–21 Oct. 6, 1989.*
Bowie et al. Science 247: 1306–1310 Mar. 1990.*
Houghton (Intelligenics).*
Nozaki et al. 32(6):591–595 1991 See English Translatation–Publicably Available May 15, 1991.*

* cited by examiner

Primary Examiner—Michael P. Woodward
(74) Attorney, Agent, or Firm—Robins & Associates; Alisa A. Harbin; Robert P. Blackburn

(57) ABSTRACT

We have discovered epitopes of the HCV viral proteins which are immunoreactive with immune serum. The epitopes are useful in immunodiagnostic assays and as immunogens.

9 Claims, 168 Drawing Sheets

FIG. 1

```
     AlaSerCysLeuAsnCysSerAlaSerIleIleProAspArgGluValLeuTyrArgGlu
  1  GGCCTCCTGCTTGAACTGCTCGGCGAGCATCATACCTGACAGGGAAGTCCTCTACCGAGA
     CCGGAGGACGAACTTGACGAGCCGCTCGTAGTATGGACTGTCCCTTCAGGAGATGGCTCT

PheAspGluMetGluGluCysSerGlnHisLeuProTyrIleGluGlnGlyMetMetLeu
 61  GTTCGATGAGATGGAAGAGTGCTCTCAGCACTTACCGTACATCGAGCAAGGGATGATGCT
     CAAGCTACTCTACCTTCTCACGAGAGTCGTGAATGGCATGTAGCTCGTTCCCTACTACGA

AlaGluGlnPheLysGlnLysAlaLeuGlyLeu
121  CGCCGAGCAGTTCAAGCAGAAGGCCCTCGGCCTCC
     GCGGCTCGTCAAGTTCGTCTTCCGGGAGCCGGAGG
```

FIG. 3

```
     GlyCysValValIleValGlyArgValValLeuSerGlyLysProAlaIleIleProAsp
  1  CTGGCTGCGTGGTCATAGTGGGCAGGGTCGTCTTGTCCGGGAAGCCGGCAATCATACCTG
     GACCGACGCACCAGTATCACCCGTCCCAGCAGAACAGGCCCTTCGGCCGTTAGTATGGAC

T
     ArgGluValLeuTyrArgGluPheAspGluMetGluGluCysSerGlnHisLeuProTyr
 61  ACAGGGAAGTCCTCTACCGAGAGTTCGATGAGATGGAAGAGTGCTCTCAGCACTTACCGT
     TGTCCCTTCAGGAGATGGCTCTCAAGCTACTCTACCTTCTCACGAGAGTCGTGAATGGCA
                                                                A

IleGluGlnGlyMetMetLeuAlaGluGlnPheLysGlnLysAlaLeuGlyLeuLeuGln
121  ACATCGAGCAAGGGATGATGCTCGCCGAGCAGTTCAAGCAGAAGGCCCTCGGCCTCCTGC
     TGTAGCTCGTTCCCTACTACGAGCGGCTCGTCAAGTTCGTCTTCCGGGAGCCGGAGGACG

ThrAlaSerArgGlnAlaGluValIleAlaProAlaValGlnThrAsnTrpGlnLysLeu
181  AGACCGCGTCCCGTCAGGCAGAGGTTATCGCCCCTGCTGTCCAGACCAACTGGCAAAAAC
     TCTGGCGCAGGGCAGTCCGTCTCCAATAGCGGGGACGACAGGTCTGGTTGACCGTTTTTG

GluThrPheTrpAlaLysHisMetTrpAsnPheIleSerGlyIleGlnTyrLeuAlaGly
241  TCGAGACCTTCTGGGCGAAGCATATGTGGAACTTCATCAGTGGGATACAATACTTGGCGG
     AGCTCTGGAAGACCCGCTTCGTATACACCTTGAAGTAGTCACCCTATGTTATGAACCGCC

LeuSerThrLeuProGlyAsnProAlaIleAlaSerLeuMetAlaPheThrAlaAlaVal
301  GCTTGTCAACGCTGCCTGGTAACCCCGCCATTGCTTCATTGATGGCTTTTACAGCTGCTG
     CGAACAGTTGCGACGGACCATTGGGGCGGTAACGAAGTAACTACCGAAAATGTCGACGAC

ThrSerProLeuThrThrSerGln
361  TCACCAGCCCACTAACCACTAGCCAAA
     AGTGGTCGGGTGATTGGTGATCGGTTT
```

FIG. 2

```
5-1-1   1                                              [ggcctcctgcttgaactgctcggcgagc]ATCATACCTGACAGGGAAG
                                                                                   ||||||||||||||||||
81      1                                       GTCCGGGAAGCCGGCAATCATACCTGACAGGGAAG
                                                |||||||||||||||||||||||||||||||||||
91      1  ctggctgcgtGGTCATAGTGGGCAGGGTCGTCTTGTCCGGGAAGCCGGCAATCATACCTGACAGGGAAG
                     ||||||||||||||||||||||||||||||||||||||||||||||||||||||||||
1-2     1                         GGTCATAGTGGGCAGGGTCGTCTTGTCCGGGAAGCCGGCAATCATACCTGACAGGGAAG 5-1-1   48  TCCTCTACCGAGAGTTCGATGAGATGGAAGAGAGTGCTCTCAGCACTTACCGTACATCGAGCAAGGGATGATGC
            ||||||||||||||||||||||||||||||||||||||||||||||||||||||||||||||||||||||||
81      36  TCCTCTACCGAGAGTTCGATGAGATGGAAGAGAGTGCTCTCAGCACTTACCGTACATCGAGCAAGGGATGATGC
            ||||||||||||||||||||||||||||||||||||||||||||||||||||||||||||||||||||||||
91      70  TCCTCTACCGAGAGTTCGATGAGATGGAAGAGAGTGCTCTCAGCACTTACCGTACATCGAGCAAGGGATGATGC
            ||||||||||||||||||||||||||||||||||||||||||||||||||||||||||||||||||||||||
1-2     60  TCCTCTAtCGAGAtCGATGAGATGGAAGAGAGTGCTCTCAGCACTTACCGTACATCGAGCAAGGGATGATGC 5-1-1   120 TCGCCGAGCAGTTCAAGCAGAAGGCCCTCGGCCTCC
            ||||||||||||||||||||||||||||||||||||
81      108 TCGCCGAGCAGTTCAAGCAGAAGGCCCTCGGCCTCCTGCAGACCGCGTCCCGTCAGGCAGAGGTTATCGCCC
            ||||||||||||||||||||||||||||||||||||||||||||||||||||||||||||||||||||||
91      142 TCGCCGAGCAGTTCAAGCAGAAGGCCCTCGGCCTCCTGCAGACCGCGTCCCGTCAGGCAGAGGTTATCGCCC
            ||||||||||||||||||||||||||||||||||||||||||||||||||||||||||||||||||||||
1-2     132 TCGCCGAGCAGTTCAAGCAGAAGGCCCTCGGCC 5-1-1   180 CTGCTGTCCAGACCAACTGGCAAAAACTGGAGACCTTTCTGGGCGAAGCATATGTGGAACTTCATCAGTGGGA
            ||||||||||||||||||||||||||||||||||||||||||||||||||||||||||||||||||||||||
81      214 CTGCTGTCCAGACCAACTGGCAAAAACTGGAGACCTTTCTGGGCGAAGCATATGTGGAACTTCATCAGTGGGA 91      252 TACAATACTTGGCGGGCTTGTCAACGCTGCCTGGtaaccccgccattgcttcattgatggcttttacagctg
            |||||||||||||||||||||||||||||||||||
1-2     286 TACAATACTTGGCGGGCTTGTCAACGCTGCCTGG 91      324 ctgtcaccagcccactaaccactagccaaa
```

FIG. 4

```
    SerGlyLysProAlaIleIleProAspArgGluValLeuTyrArgGluPheAspGluMet
  1 GTCCGGGAAGCCGGCAATCATACCTGACAGGGAAGTCCTCACCGAGAGTTCGATGAGAT
    CAGGCCCTTCGGCCGTTAGTATGGACTGTCCCTTCAGGAGATGGCTCTCAAGCTACTCTA

GluGluCysSerGlnHisLeuProTyrIleGluGlnGlyMetMetLeuAlaGluGlnPhe
 61 GGAAGAGTGCTCTCAGCACTTACCGTACATCGAGCAAGGATGATGCTCGCCGAGCAGTT
    CCTTCTCACGAGAGTCGTGAATGGCATGTAGCTCGTTCCCTACTACGAGCGGCTCGTCAA

LysGlnLysAlaLeuLeuGlnThrAlaSerArgGlnAlaGluValIleAlaAlaPro
121 CAAGCAGAAGGCCCTCGGCCTCCTGCAGACCGCGTCCCGTCAGGCAGAGTTATGCGCCC
    GTTCGTCTTCCGGGAGCCGGAGACGTCTGGCGCAGGGCAGTCCGTCTCCAATAGCGGGG

AlaValGlnThrAsnTrpGlnLysLeuGluThrPheTrpAlaLysHisMetTrpAsnPhe
181 TGCTGTCCAGACCAACTGGCAAAAACTCGAGACCTTCTGGGCGAAGCATATGTGGAACTT
    ACGACAGGTCTGGTTGACCGTTTTTGAGCTCTGGAAGACCCGCTTCGTATACACCTTGAA

IleSerGlyIleGlnTyrLeuAlaGlyLeuSerThrLeuProGlyAsnProAlaIleAla
241 CATCAGTGGGATACAATACTTGGCGGGCTTGTCAACCTGCCTGGTAACCCCGCCATTGC
    GTAGTCACCCTATGTTATGAACCGCCCGAACAGTTGGACGGACCATTGGGGCGGTAACG

SerLeuMetAlaPheThrAlaAlaValThrSerProLeuThrThrSerGln
301 TTCATTGATGGCTTTACAGCTGCTGTCACCAGCCCACTAACCACTAGCCAAA
    AAGTAACTACCGAAAATGTCGACGACAGTGGTCGGGTGATTGGTGATCGGTTT
```

FIG. 5

```
    AspAlaHisPheLeuSerGlnThrLysGlnSerGlyGluAsnLeuProTyrLeuValAla
  1 GATGCCCACTTCTATCCAGACAAAGCAGAGTGGGGAGAACCTTCCTTACCTGGTAGCG
    CTACGGGTGAAAGATAGGGTCTGTTTCGTCACCCCTCTTGGAAGGAATGGACCATCGC

TyrGlnAlaThrValCysAlaArgAlaGlnAlaProProProSerTrpAspGlnMetTrp
 61 TACCAAGCCACCGTGTGCGCTAGGGCTCAAGCCCCTCCCCCATCGTGGGACCAGATGTGG
    ATGGTTCGGTGGCACACGCGATCCCGAGTTCGGGGAGGGGTAGCACCCTGGTCTACACC

LysCysLeuIleArgLeuLysProThrLeuHisGlyProThrProLeuLeuTyrArgLeu
121 AAGTGTTTGATTCGCCTCAAGCCCACCCTCCATGGGCCAACACCCTGCTATACAGACTG
    TTCACAAACTAAGCGGAGTTCGGGTGGGACGATATGTCTGAC

GlyAlaValGlnAsnGluIleThrLeuThrHisProValThrLysTyrIleMetThrCys
181 GGCGCTGTTCAGAATGAAATCACCCTGACGCACCCAGTCACCAAATACATCATGACATGC
    CCGCGACAAGTCTTACTTTAGTGGGACTGCGTGGTCAGTGGTTTATGTAGTACTGTACG

MetSerAlaAspLeuGluValValThrSerThrTrpValThrGlyCysValValLeuAla
241 ATGTCGGCCGACCTGGAGGTCGTCACGAGCACCTGGGTGACCGGCTGTGTTGGCGGTCCTGCT
    TACAGCCGGCTGGACCTCCAGCAGTGCTCGTGGACCCACTGGCCGACAACCGCCAGGACCGA

AlaLeuAlaAlaTyrCysLeuSerThrGlyCysValValIleValGlyArgValValLeu
301 GCTTTGGCCGCCGTATGCCTGTCAACAGGCTGCGTGGTCATAGTGGGCAGGGTCGTCTTG
    CGAAACCGGCGGCATACGGACAGTTGTCCGACGCACCAGTATCACCCGTCCCAGCAGAAC

────────Overlap with 81────────
    SerGlyLysProAlaIleIleProAspArgGluValLeuTyrArg
361 TCCGGGAAGCCGGCAATCATACCTGACAGGGAAGTCCTCTACCGAG
    AGGCCCTTCGGCCGTTAGTATGGACTGTCCCTTCAGGAGATGGCTC
```

FIG. 6

```
     AspAlaHisPheLeuSerGlnThrLysGlnSerGlyGluAsnLeuProTyrLeuValAla
  1  GATGCCCACTTTCTATCCCAGACAAAGCAGAGTGGGGAGAACCTTCCTTACCTGGTAGCG
     CTACGGGTGAAAGATAGGGTCTGTTTCGTCTCACCCCTCTTGGAAGGAATGGACCATCGC

TyrGlnAlaThrValCysAlaArgAlaGlnAlaProProProSerTrpAspGlnMetTrp
 61  TACCAAGCCACCGTGTGCGCTAGGGCTCAAGCCCCTCCCCCATCGTGGGACCAGATGTGG
     ATGGTTCGGTGGCACACGCGATCCCGAGTTCGGGGAGGGGGTAGCACCCTGGTCTACACC

LysCysLeuIleArgLeuLysProThrLeuHisGlyProThrProLeuLeuTyrArgLeu
121  AAGTGTTTGATTCGCCTCAAGCCCACCCTCCATGGGCCAACACCCCTGCTATACAGACTG
     TTCACAAACTAAGCGGAGTTCGGGTGGGAGGTACCCGGTTGTGGGACGATATGTCTGAC

GlyAlaValGlnAsnGluIleThrLeuThrHisProValThrLysTyrIleMetThrCys
181  GGCGCTGTTCAGAATGAAATCACCCTGACGCACCCAGTCACCAAATACATCATGACATGC
     CCGCGACAAGTCTTACTTTAGTGGGACTGCGTGGGTCAGTGGTTTATGTAGTACTGTACG

MetSerAlaAspLeuGluValValThrSerThrTrpValLeuValGlyGlyValLeuAla
241  ATGTCGGCCGACCTGGAGGTCGTCACGAGCACCTGGGTGCTCGTTGGCGGCGTCCTGGCT
     TACAGCCGGCTGGACCTCCAGCAGTGCTCGTGGACCCACGAGCAACCGCCGCAGGACCGA

AlaLeuAlaAlaTyrCysLeuSerThrGlyCysValValIleValGlyArgValValLeu
301  GCTTTGGCCGCGTATTGCCTGTCAACAGGCTGCGTGGTCATAGTGGGCAGGGTCGTCTTG
     CGAAACCGGCGCATAACGGACAGTTGTCCGACGCACCAGTATCACCCGTCCCAGCAGAAC

SerGlyLysProAlaIleIleProAspArgGluValLeuTyrArgGluPheAspGluMet
361  TCCCGGAAGCCGGCAATCATACCTGACAGGGAAGTCCTCTACCGAGAGTTCGATGAGATG
     AGGGCCTTCGGCCGTTAGTATGGACTGTCCCTTCAGGAGATGGCTCTCAAGCTACTCTAC

GluGluCysSerGlnHisLeuProTyrIleGluGlnGlyMetMetLeuAlaGluGlnPhe
421  GAAGAGTGCTCTCAGCACTTACCGTACATCGAGCAAGGGATGATGCTCGCCGAGCAGTTC
     CTTCTCACGAGAGTCGTGAATGGCATGTAGCTCGTTCCCTACTACGAGCGGCTCGTCAAG

LysGlnLysAlaLeuGlyLeuLeuGlnThrAlaSerArgGlnAlaGluValIleAlaPro
481  AAGCAGAAGGCCCTCGGCCTCCTGCAGACCGCGTCCCGTCAGGCAGAGGTTATCGCCCCT
     TTCGTCTTCCGGGAGCCGGAGGACGTCTGGCGCAGGGCAGTCCGTCTCCAATAGCGGGGA

AlaValGlnThrAsnTrpGlnLysLeuGluThrPheTrpAlaLysHisMetTrpAsnPhe
541  GCTGTCCAGACCAACTGGCAAAAACTCGAGACCTTCTGGGCGAAGCATATGTGGAACTTC
     CGACAGGTCTGGTTGACCGTTTTTGAGCTCTGGAAGACCCGCTTCGTATACACCTTGAAG

IleSerGlyIleGlnTyrLeuAlaGlyLeuSerThrLeuProGlyAsnProAlaIleAla
601  ATCAGTGGGATACAATACTTGGCGGGCTTGTCAACGCTGCCTGGTAACCCCGCCATTGCT
     TAGTCACCCTATGTTATGAACCGCCCGAACAGTTGCGACGGACCATTGGGGCGGTAACGA

SerLeuMetAlaPheThrAlaAlaValThrSerProLeuThrThrSerGln
661  TCATTGATGGCTTTTACAGCTGCTGTCACCAGCCCACTAACCACTAGCCAAA
     AGTAACTACCGAAAATGTCGACGACAGTGGTCGGGTGATTGGTGATCGGTTT
```

FIG. 7

```
      ------Overlap with 81---------------------
      PheThrAlaAlaValThrSerProLeuThrThrSerGlnThrLeuLeuPheAsnIleLeu
  1   CTTTTACAGCTGCTGTCACCAGCCCACTAACCACTAGCCAAACCCTCCTCTTCAACATAT .
      GAAAATGTCGACGACAGTGGTCGGGTGATTGGTGATCGGTTTGGGAGGAGAAGTTGTATA GlyGlyTrpValAlaAlaGlnLeuAlaAlaProGlyAlaAlaThrAlaPheValGlyAla
 61   TGGGGGGGTGGGTGGCTGCCCAGCTCGCCGCCCCGGTGCCGCTACTGCCTTTGTGGGCG
      ACCCCCCCACCCACCGACGGGTCGAGCGGCGGGGGCCACGGCGATGACGGAAACACCCGC GlyLeuAlaGlyAlaAlaIleGlySerValGlyLeuGlyLysValLeuIleAspIleLeu
121   CTGGCTTAGCTGGCGCCGCCATCGGCAGTGTTGGACTGGGGAAGGTCCTCATAGACATCC
      GACCGAATCGACCGCGGCGGTAGCCGTCACAACCTGACCCCTTCCAGGAGTATCTGTAGG AlaGlyTyrGlyAlaGlyValAlaGlyAlaLeuValAlaPheLysIleMetSerGlyGlu
181   TTGCAGGGTATGGCGCGGGCGTGGCGGGAGCTCTTGTGGCATTCAAGATCATGAGCGGTG
      AACGTCCCATACCGCGCCCGCACCGCCCTCGAGAACACCGTAAGTTCTAGTACTCGCCAC ValProSerThrGluAspLeuValAsnLeuLeuProAlaIleLeuSerProGlyAlaLeu
241   AGGTCCCCTCCACGGAGGACCTGGTCAATCTACTGCCCGCCATCCTCTCGCCCGGAGCCC
      TCCAGGGGAGGTGCCTCCTGGACCAGTTAGATGACGGGCGGTAGGAGAGCGGGCCTCGGG ValValGlyValValCysAlaAlaIleLeuArgArgHisValGlyProGlyGluGlyAla
301   TCGTAGTCGGCGTGGTCTGTGCAGCAATACTGCGCCGGCACGTTGGCCCGGGCGAGGGGG
      AGCATCAGCCGCACCAGACACGTCGTTATGACGCGGCCGTGCAACCGGGCCCGCTCCCCC ValGlnTrpMetAsnArgLeuIleAlaPheAlaSerArgGlyAsnHisValSer
361   CAGTGCAGTGGATGAACCGGCTGATAGCCTTCGCCTCCCGGGGGAACCATGTTTCCCC
      GTCACGTCACCTACTTGGCCGACTATCGGAAGCGGAGGGCCCCCTTGGTACAAAGGGG
```

FIG. 8A

```
    SerIleGluThrIleThrLeuProGlnAspAlaValSerArgThrGlnArgArgGlyArg
  1 TCCATTGAGACAATCACGCTCCCCCAGGATGCTGTCTCCCGACTCAACGTCGGGGCAGG
    AGGTAACTCTGTTAGTGCGAGGGGGTCCTACGACAGAGGGCGTGAGTTGCAGCCCCGTCC

ThrGlyArgGlyLysProGlyIleTyrArgPheValAlaProGlyGluProGlySerGly
 61 ACTGGCAGGGGGAAGCCAGGCATCTACAGATTTGTGGCACCGGGGGAGCGCCCCTCCGGC
    TGACCGTCCCCCCTTCGGTCCGTAGATGTCTAAACACCGTGGCCCCCTCGCGGGGAGGCCG

MetPheAspSerSerValLeuCysGluCysTyrAspAlaGlyCysAlaTrpTyrGluLeu
121 ATGTTCGACTCGTCCGTCCTCTGTGAGTGCTATGACGCAGGCTGTGCTTGGTATGAGCTC
    TACAAGCTGAGCAGGCAGGAGACACTCACGATACTGCGTCCGACACGAACCATACTCGAG

ThrProAlaGluThrThrValArgLeuArgAlaTyrMetAsnThrProGlyLeuProVal
181 ACGCCCGCCGAGACTACAGTTAGGCTACGAGCGTACATGAACACCCCGGGCTTCCCGTG
    TGCGGGCGGCTCTGATGTCAATCCGATGCTCGCATGTACTTGTGGGGCCCGAAGGGCAC
```

FIG. 8B

```
       CysGlnAspHisLeuGluPheThrGlyGluGlyValPheThrGlyLeuThrHisIleAspAla
241  TGCCAGGACCATCTTGAATTTGGGAGGCGTCTTTACAGGCCTCACTCATATAGATGCC
     ACGGTCCTGGTAGAACTTAAACCCTCCGCAGAAATGTCCGGAGTGAGTATATCTACGG

HisPheLeuSerGlnThrLysGlnSerGlyGluAsnLeuProTyrLeuValAlaTyrGln
301  CACTTTCTATCCCAGACACAAAGCAGAGTGGGAGAACCTTCCTTACCTGGTAGCGTACCAA
     GTGAAAGATAGGGTCTGTGTTTCGTCTCACCCTCTTGGAAGGAATGGACCATCGCATGTT

--------Overlap with 36--------
       AlaThrValCysAlaAlaArgAlaAlaGlnAlaProProSerTrpAspGlnMetTrpLysCys
361  GCCACCGTGTGCGCTAGGGCTGCTCAAGCCCCTCCCAGTTCGTGGGACCAGATGTGGAAGTGT
     CGGTGGCACACGCGATCCCGAGTTCGGGAGGGGTCAAGCACCCTGGTCTACACCTTCACA LeuIleArgLeuLysProThrProLeuLeuTyrArgLeuLeuGlyAla
421  TTGATTCGCCTCAAGCCCACCCCTCCATGGCCAACACCCTGCTATACAGACTGGGGCT
     AACTAAGCGGAGTTCGGGTGGGGAGGTACCGGTTGTGGGACGATATGTCTGACCCCGCGA
```

FIG. 9A

```
      SerIleGluThrIleThrLeuProGlnAspAlaValSerArgThrGlnArgArgGlyArg
  1   TCCATTGAGACAATCACGCTCCCCCAGGATGCTGTCTCCCGCACTCAACGTCGGGGCAGG
      AGGTAACTCTGTTAGTGCGAGGGGGTCCTACGACAGAGGGCGTGAGTTGCAGCCCCGTCC

ThrGlyArgGlyLysProGlyIleTyrArgPheValAlaProGlyGluArgProSerGly
 61   ACTGGCAGGGGGAAGCCAGGCATCTACAGATTTGTGGCACCGGGGGAGCGCCCCTCCGGC
      TGACCGTCCCCCTTCGGTCCGTAGATGTCTAAACACCGTGGCCCCCTCGCGGGGAGGCCG

MetPheAspSerSerValLeuCysGluCysTyrAspAlaGlyCysAlaTrpTyrGluLeu
121   ATGTTCGACTCGTCCGTCCTCTGTGAGTGCTATGACGCAGGCTGTGCTTGGTATGAGCTC
      TACAAGCTGAGCAGGCAGGAGACACTCACGATACTGCGTCCGACACGAACCATACTCGAG

ThrProAlaGluThrThrValArgLeuArgAlaTyrMetAsnThrProGlyLeuProVal
181   ACGCCCGCCGAGACTACAGTTAGGCTACGAGCGTACATGAACACCCCGGGGCTTCCCGTG
      TGCGGGCGGCTCTGATGTCAATCCGATGCTCGCATGTACTTGTGGGGCCCCGAAGGGCAC

CysGlnAspHisLeuGluPheTrpGluGlyValPheThrGlyLeuThrHisIleAspAla
241   TGCCAGGACCATCTTGAATTTTGGGAGGGCGTCTTTACAGGCCTCACTCATATAGATGCC
      ACGGTCCTGGTAGAACTTAAAACCCTCCCGCAGAAATGTCCGGAGTGAGTATATCTACGG

HisPheLeuSerGlnThrLysGlnSerGlyGluAsnLeuProTyrLeuValAlaTyrGln
301   CACTTTCTATCCCAGACAAAGCAGAGTGGGGAGAACCTTCCTTACCTGGTAGCGTACCAA
      GTGAAAGATAGGGTCTGTTTCGTCTCACCCCTCTTGGAAGGAATGGACCATCGCATGGTT

AlaThrValCysAlaArgAlaGlnAlaProProProSerTrpAspGlnMetTrpLysCys
361   GCCACCGTGTGCGCTAGGGCTCAAGCCCCTCCCCCATCGTGGGACCAGATGTGGAAGTGT
      CGGTGGCACACGCGATCCCGAGTTCGGGGAGGGGGTAGCACCCTGGTCTACACCTTCACA

LeuIleArgLeuLysProThrLeuHisGlyProThrProLeuLeuTryArgLeuGlyAla
421   TTGATTCGCCTCAAGCCCACCCTCCATGGGCCAACACCCCTGCTATACAGACTGGGCGCT
      AACTAAGCGGAGTTCGGGTGGGAGGTACCCGGTTGTGGGGACGATATGTCTGACCCGCGA

ValGlnAsnGluIleThrLeuThrHisProValThrLysTyrIleMetThrCysMetSer
481   GTTCAGAATGAAATCACCCTGACGCACCCAGTCACCAAATACATCATGACATGCATGTCG
      CAAGTCTTACTTTAGTGGGACTGCGTGGGTCAGTGGTTTATGTAGTACTGTACGTACAGC

AlaAspLeuGluValValThrSerThrTrpValLeuValGlyGlyValLeuAlaAlaLeu
541   GCCGACCTGGAGGTCGTCACGAGCACCTGGGTGCTCGTTGGCGGCGTCCTGGCTGCTTTG
      CGGCTGGACCTCCAGCAGTGCTCGTGGACCCACGAGCAACCGCCGCAGGACCGACGAAAC

AlaAlaTyrCysLeuSerThrGlyCysValValIleValGlyArgValValLeuSerGly
601   GCCGCGTATTGCCTGTCAACAGGCTGCGTGGTCATAGTGGGCAGGGTCGTCTTGTCCGGG
      CGGCGCATAACGGACAGTTGTCCGACGCACCAGTATCACCCGTCCCAGCAGAACAGGCCC

LysProAlaIleIleProAspArgGluValLeuTyrArgGluPheAspGluMetGluGlu
661   AAGCCGGCAATCATACCTGACAGGGAAGTCCTCTACCGAGAGTTCGATGAGATGGAAGAG
      TTCGGCCGTTAGTATGGACTGTCCCTTCAGGAGATGGCTCTCAAGCTACTCTACCTTCTC

CysSerGlnHisLeuProTyrIleGluGlnGlyMetMetLeuAlaGluGlnPheLysGln
721   TGCTCTCAGCACTTACCGTACATCGAGCAAGGGATGATGCTCGCCGAGCAGTTCAAGCAG
      ACGAGAGTCGTGAATGGCATGTAGCTCGTTCCCTACTACGAGCGGCTCGTCAAGTTCGTC

LysAlaLeuGlyLeuLeuGlnThrAlaSerArgGlnAlaGluValIleAlaProAlaVal
781   AAGGCCCTCGGCCTCCTGCAGACCGCGTCCCGTCAGGCAGAGGTTATCGCCCCTGCTGTC
      TTCCGGGAGCCGGAGGACGTCTGGCGCAGGGCAGTCCGTCTCCAATAGCGGGGACGACAG
```

FIG. 9B

```
     GlnThrAsnTrpGlnLysLeuGluThrPheTrpAlaLysHisMetTrpAsnPheIleSer
841  CAGACCAACTGGCAAAAACTCGAGACCTTCTGGGCGAAGCATATGTGGAACTTCATCAGT
     GTCTGGTTGACCGTTTTTGAGCTCTGGAAGACCCGCTTCGTATACACCTTGAAGTAGTCA

GlyIleGlnTyrLeuAlaGlyLeuSerThrLeuProGlyAsnProAlaIleAlaSerLeu
901  GGGATACAATACTTGGCGGGCTTGTCAACGCTGCCTGGTAACCCCGCCATTGCTTCATTG
     CCCTATGTTATGAACCGCCCGAACAGTTGCGACGGACCATTGGGGCGGTAACGAAGTAAC

MetAlaPheThrAlaAlaValThrSerProLeuThrThrSerGlnThrLeuLeuPheAsn
961  ATGGCTTTTACAGCTGCTGTCACCAGCCCACTAACCACTAGCCAAACCCTCCTCTTCAAC
     TACCGAAAATGTCGACGACAGTGGTCGGGTGATTGGTGATCGGTTTGGGAGGACAAGTTG

IleLeuGlyGlyTrpValAlaAlaGlnLeuAlaAlaProGlyAlaAlaThrAlaPheVal
1021 ATATTGGGGGGGTGGGTGGCTGCCCAGCTCGCCGCCCCGGTGCCGCTACTGCCTTTGTG
     TATAACCCCCCCACCCACCGACGGGTCGAGCGGCGGGGGCCACGGCGATGACGGAAACAC

GlyAlaGlyLeuAlaGlyAlaAlaIleGlySerValGlyLeuGlyLysValLeuIleAsp
1081 GGCGCTGGCTTAGCTGGCGCCGCCATCGGCAGTGTTGGACTGGGGAAGGTCCTCATAGAC
     CCGCGACCGAATCGACCGCGGCGGTAGCCGTCACAACCTGACCCCTTCCAGGAGTATCTG

IleLeuAlaGlyTyrGlyAlaGlyValAlaGlyAlaLeuValAlaPheLysIleMetSer
1141 ATCCTTGCAGGGTATGGCGCGGGCGTGGCGGGAGCTCTTGTGGCATTCAAGATCATGAGC
     TAGGAACGTCCCATACCGCGCCCGCACCGCCCTCGAGAACACCGTAAGTTCTAGTACTCG

GlyGluValProSerThrGluAspLeuValAsnLeuLeuProAlaIleLeuSerProGly
1201 GGTGAGGTCCCCTCCACGGAGGACCTGGTCAATCTACTGCCCGCCATCCTCTCGCCCGGA
     CCACTCCAGGGGAGGTGCCTCCTGGACCAGTTAGATGACGGGCGGTAGGAGAGCGGGCCT

AlaLeuValValGlyValValCysAlaAlaIleLeuArgArgHisValGlyProGlyGlu
1261 GCCCTCGTAGTCGGCGTGGTCTGTGCAGCAATACTGCGCCGGCACGTTGGCCCGGGCGAG
     CGGGAGCATCAGCCGCACCAGACACGTCGTTATGACGCGGCCGTGCAACCGGGCCCGCTC

GlyAlaValGlnTrpMetAsnArgLeuIleAlaPheAlaSerArgGlyAsnHisValSer
1321 GGGGCAGTGCAGTGGATGAACCGGCTGATAGCCTTCGCCTCCCGGGGGAACCATGTTTCCCC
     CCCCGTCACGTCACCTACTTGGCCGACTATCGGAAGCGGAGGGCCCCCTTGGTACAAAGGGG
```

FIG. 10

```
    LeuAlaAlaLysLeuValAlaLeuGlyIleAsnAlaValAlaAlaTyrTyrArgGlyLeuAsp
  1 CTCGCCGCCAAAGCTGGTCGCATTGGGCATCAATGCCGTGGCCTACTACCGCGGTCTTGAC
    GAGCGGCGGTTTCGACCAGCGTAACCCGTAGTTACGGCACCGGATGATGGCGCCAGAACTG

ValSerValIleProThrSerGlyAspValValValValAlaThrAspAlaLeuMetThr
 61 GTGTCCGTCATCCCGACCAGCGGGGACGATGTTGTCGTGGCAACCGATGCCCTCATGACC
    CACAGGCAGTAGGGCTGGTCGCCCCTGCTACAACAGCACCGTTGGCTACGGGAGTACTGG

GlyTyrThrGlyAspPheAspSerValIleAspTyrAsnThrCysValThrGlnThrVal
121 GGCTATACCGGCGACTTCGACTCGGTGATAGACTACAATACGTGTGTCACCCAGACAGTC
    CCGATATGGCCGCTGAAGCTGAGCCACTATCTGATGTTATGCACACAGTGGGTCTGTCAG

------Overlap with
    AspPheSerLeuAspProThrPheThrIleGluThrIleThrLeuProGlnAspAlaVal
181 GATTTCAGCCTTGACCCTACCTTCACCATTGAGACAATCACGCTCCCCAGGATGCTGTC
    CTAAAGTCGGAACTGGGATGGAAGTGGTAACTCTGTTAGTGCGAGGGGTCCTACGACAG clone 35----------------
    SerArgThrGlnArgArgGlyArgThr
241 TCCCGCACTCAACGTCGGGGCAGGACTG
    AGGGCGTGAGTTGCAGCCCCGTCCTGAC
```

FIG. 11

```
      -------Overlap with 32--------------------------
       MetAsnArgLeuIleAlaPheAlaSerArgGlyAsnHisValSerProThrHisTyrVal
  1   GATGAACCGGCTGATAGCCTTCGCCTCCCGGGGGAACCATGTTTCCCCCACGCACTACGT
      CTACTTGGCCGACTATCGGAAGCGGAGGGCCCCCTTGGTACAAAGGGGGTGCGTGATGCA ProGluSerAspAlaAlaAlaArgValThrAlaIleLeuSerSerLeuThrValThrGln
 61   GCCGGAGAGCGATGCAGCTGCCCGCGTCACTGCCATACTCAGCAGCCTCACTGTAACCCA
      CGGCCTCTCGCTACGTCGACGGGCGCAGTGACGGTATGAGTCGTCGGAGTGACATTGGGT LeuLeuArgArgLeuHisGlnTrpIleSerSerGluCysThrThrProCysSerGlySer
121   GCTCCTGAGGCGACTGCACCAGTGGATAAGCTCGGAGTGTACCACTCCATGCTCCGGTTC
      CGAGGACTCCGCTGACGTGGTCACCTATTCGAGCCTCACATGGTGAGGTACGAGGCCAAG TrpLeuArgAspIleTrpAspTrpIleCysGluValLeuSerAspPheLysThrTrpLeu
181   CTGGCTAAGGGACATCTGGGACTGGATATGCGAGGTGTTGAGCGACTTTAAGACCTGGCT
      GACCGATTCCCTGTAGACCCTGACCTATACGCTCCACAACTCGCTGAAATTCTGGACCGA LysAlaLysLeuMetProGlnLeuProGlyIleProPheValSerCysGlnArgGlyTyr
241   AAAAGCTAAGCTCATGCCACAGCTGCCTGGGATCCCCTTTGTGTCCTGCCAGCGCGGGTA
      TTTTCGATTCGAGTACGGTGTCGACGGACCCTAGGGGAAACACAGGACGGTCGCGCCCAT LysGlyValTrpArgVal
301   TAAGGGGGTCTGGCGAGTG
      ATTCCCCCAGACCGCTCAC
```

```
         AlaTyrMetSerLysAlaHisGlyIleAspProAsnIleArgThrGlyValArgThrIle
  1   GGCTTACATGTCCAAGGCTCATGGGATCGATCCTAACATCAGGACCGGGGTGAGAACAAT
      CCGAATGTACAGGTTCCGAGTACCCTAGGATTGTAGTCCTGGCCCCACTCTTGTTA

ThrThrGlySerProIleThrTyrSerThrTyrGlyLysPheLeuAlaAspGlyGlyCys
 61   TACCACTGGCAGCCCCATCACGTACTCCACCTACGGCAAGTTCCTTGCCGACGGCGGTG
      ATGGTGACCGTCGGGGGTAGTGCATGAGGTGGATGCCGTTCAAGGAACGGCTGCCGCCAC

SerGlyGlyAlaTyrAspIleIleIleCysAspGluCysHisSerThrAspAlaThrSer
121   CTCGGGGGGCGCTTATGACATAATAATTTGTGACGAGTGCCACTCCACGGATGCCACATC
      GAGCCCCCCGAATACTGTATTATTAAACACTGCTCACGGTGAGGTGCCTACGGTGTAG

IleLeuGlyIleGlyThrValLeuAspGlnAlaGluThrAlaGlyValAlaArgLeuValVal
181   CATCTTGGGCATCGGCACTGTCCTTGACCAAGCAGAGACTGCGGGGCGAGACTGGTTGT
      GTAGAACCCGTAGCCGTGACAGGAACTGGTTCGTCTCTGACGCCCCGCTCTGACCAACA

LeuAlaThrAlaThrProProGlySerValThrValProHisProAsnIleGluGluVal
241   GCTCGCCACCGCCACCCCCACCCTCCGGCTCCGTCACTGTGCCCATCCAACATCGAGGAGGT
      CGAGCGGTGGCGGTGGGGGTGGGAGGCCGAGGCAGTGACACGGGTAGGTTGTAGCTCCTCCA

AlaLeuSerThrThrGlyLysGluIleIleProPheTyrGlyLysAlaIleProLeuValIle
301   TGCTCTGTCCACCACCGGAAGAGATCCCTTTTTACGGCAAGGCTATCCCCCTCGAAGTAAT
      ACGAGACAGGTGGTGGCCTTCTCTAGGGAAAAATGCCGTTCCGATAGGGGAGCTTCATTA

LysGlyArgHisLeuIlePheCysHisSerLysLysLysAspGluLeuAlaAla
361   AAGGGGGGGAGACATCTCATCTTCTGTCATTCAAAGAAGAAGTGCGACGAACTCGCCGC
      TTCCCCCCCTCTGTAGAGTAGAACAGTAAGTTCTTCTTCACGCTGCTTGAGCGGCG
              -----------Overlap with 37b-----------

LysLeuValAlaLeuGlyIleAsnAlaValAlaAlaTyrTyrArgGlyLeuAspValSerVal
421   AAAGCTGGTCGCATTGGCATCAATGCCGTGGCCGCCTACTACCGCGGTCTTGACGTGTCCGT
      TTTCGACCAGCGTAACCCGTAGTTACGGCACCGGCGGATGATGGCGCCAGAACTGCACAGGCA

IleProThr
481   CATCCCGACCAG
      GTAGGGCTGGTC
```

```
                 CysSerLeuThrValThrGlnLeuLeuArgArgLeuHisGlnTrpIleSerSerGluCys
  1   ACTGCAGCCTCACTGTAACCCAGCTCCTGAGGCGACTGCACCAGTGGATAAGCTCGGAGT
      TGACGTCGGAGTGACATTGGGTCGAGGACTCCGCTGACGTGGTCACCTATTCGAGCCTCA

ThrThrProCysSerGlySerTrpLeuArgAspIleTrpAspTrpIleCysGluValLeu
 61   GTACCACTCCATGCTCCGGTTCCTGGCTAAGGGACATCTGGGACTGGATATGCGAGGTGT
      CATGGTGAGGTACGAGGCCAAGGACCGATTCCCTGTAGACCCTGACCTATACGCTCCACA.

---------------Overlap with 33b---------------------------
                 SerAspPheLysThrTrpLeuLysAlaLysLeuMetProGlnLeuProGlyIleProPhe
121   TGAGCGACTTTAAGACCTGGCTAAAAGCTAAGCTCATGCCACAGCTGCCTGGGATCCCCT
      ACTCGCTGAAATTCTGGACCGATTTTCGATTCGAGTACGGTGTCGACGGACCCTAGGGGA ValSerCysGlnArgGlyTyrLysGlyValTrpArgGlyAspGlyIleMetHisThrArg
181   TTGTGTCCTGCCAGCGCGGGTATAAGGGGGTCTGGCGAGGGGACGGCATCATGCACACTC
      AACACAGGACGGTCGCGCCCATATTCCCCCAGACCGCTCCCCTGCCGTAGTACGTGTGAG CysHisCysGlyAlaGluIleThrGlyHisValLysAsnGlyThrMetArgIleValGly
241   GCTGCCACTGTGGAGCTGAGATCACTGGACATGTCAAAAACGGGACGATGAGGATCGTCG
      CGACGGTGACACCTCGACTCTAGTGACCTGTACAGTTTTTGCCCTGCTACTCCTAGCAGC ProArgThrCysArgAsnMetTrpSerGlyThrPheProIleAsnAlaTyrThrThrGly
301   GTCCTAGGACCTGCAGGAACATGTGGAGTGGGACCTTCCCCATTAATGCCTACACCACGG
      CAGGATCCTGGACGTCCTTGTACACCTCACCCTGGAAGGGGTAATTACGGATGTGGTGCC ProCysThrProLeuProAlaProAsnTyrThrPheAlaLeuTrpArgValSerAlaGlu
361   GCCCCTGTACCCCCCTTCCTGCGCCGAACTACACGTTCGCGCTATGGAGGGTGTCTGCAG
      CGGGGACATGGGGGGAAGGACGCGGCTTGATGTGCAAGCGCGATACCTCCCACAGACGTC GluTyrValGluIleArgGlnValGlyAspPheHisTyrValThrGlyMetThrThrAsp
421   AGGAATATGTGGAGATAAGGCAGGTGGGGGACTTCCACTACGTGACGGGTATGACTACTG
      TCCTTATACACCTCTATTCCGTCCACCCCCTGAAGGTGATGCACTGCCCATACTGATGAC AsnLeuLysCysProCysGlnValProSerProGluPhePheThrGlu
481   ACAATCTCAAATGCCCGTGCCAGGTCCCATCGCCCGAATTTTTCACAGAAT
      TGTTAGAGTTTACGGGCACGGTCCAGGGTAGCGGGCTTAAAAAGTGTCTTA
```

FIG. 14A

```
    AlaTyrMetSerLysAlaHisGlyIleAspProAsnIleArgThrGlyValArgThrIle
  1 TGCTTACATGTCCAAGGCTCATGGGATCGATCCTAACATCAGGACCGGGGTGAGAACAAT
    ACGAATGTACAGGTTCCGAGTACCCTAGCTAGGATTGTAGTCCTGGCCCCACTCTTGTTA

ThrThrGlySerProIleThrTyrSerThrTyrGlyLysPheLeuAlaAspGlyGlyCys
 61 TACCACTGGCAGCCCCATCACGTACTCCACCTACGGCAAGTTCCTTGCCGACGGCGGGTG
    ATGGTGACCGTCGGGGTAGTGCATGAGGTGGATGCCGTTCAAGGAACGGCTGCCGCCCAC

SerGlyGlyAlaTyrAspIleIleIleCysAspGluCysHisSerThrAspAlaThrSer
121 CTCGGGGGGCGCTTATGACATAATAATTTGTGACGAGTGCCACTCCACGGATGCCACATC
    GAGCCCCCCGCGAATACTGTATTATTAAACACTGCTCACGGTGAGGTGCCTACGGTGTAG

IleLeuGlyIleGlyThrValLeuAspGlnAlaGluThrAlaGlyAlaArgLeuValVal
181 CATCTTGGGCATCGGCACTGTCCTTGACCAAGCAGAGACTGCGGGGGCGAGACTGGTTGT
    GTAGAACCCGTAGCCGTGACAGGAACTGGTTCGTCTCTGACGCCCCCGCTCTGACCAACA

LeuAlaThrAlaThrProProGlySerValThrValProHisProAsnIleGluGluVal
241 GCTCGCCACCGCCACCCCTCCGGGCTCCGTCACTGTGCCCCATCCCAACATCGAGGAGGT
    CGAGCGGTGGCGGTGGGGAGGCCCGAGGCAGTGACACGGGGTAGGGTTGTAGCTCCTCCA

AlaLeuSerThrThrGlyGluIleProPheTyrGlyLysAlaIleProLeuGluValIle
301 TGCTCTGTCCACCACCGGAGAGATCCCTTTTTACGGCAAGGCTATCCCCCTCGAAGTAAT
    ACGAGACAGGTGGTGGCCTCTCTAGGGAAAAATGCCGTTCCGATAGGGGGAGCTTCATTA

LysGlyGlyArgHisLeuIlePheCysHisSerLysLysLysCysAspGluLeuAlaAla
361 CAAGGGGGGGAGACATCTCATCTTCTGTCATTCAAAGAAGAAGTGCGACGAACTCGCCGC
    GTTCCCCCCCTCTGTAGAGTAGAAGACAGTAAGTTTCTTCTTCACGCTGCTTGAGCGGCG

LysLeuValAlaLeuGlyIleAsnAlaValAlaTyrTyrArgGlyLeuAspValSerVal
421 AAAGCTGGTCGCATTGGGCATCAATGCCGTGGCCTACTACCGCGGTCTTGACGTGTCCGT
    TTTCGACCAGCGTAACCCGTAGTTACGGCACCGGATGATGGCGCCAGAACTGCACAGGCA

IleProThrSerGlyAspValValValValAlaThrAspAlaLeuMetThrGlyTyrThr
481 CATCCCGACCAGCGGCGATGTTGTCGTCGTGGCAACCGATGCCCTCATGACCGGCTATAC
    GTAGGGCTGGTCGCCGCTACAACAGCAGCACCGTTGGCTACGGGAGTACTGGCCGATATG

GlyAspPheAspSerValIleAspTyrAsnThrCysValThrGlnThrValAspPheSer
541 CGGCGACTTCGACTCGGTGATAGACTACAATACGTGTGTCACCCAGACAGTCGATTTCAG
    GCCGCTGAAGCTGAGCCACTATCTGATGTTATGCACACAGTGGGTCTGTCAGCTAAAGTC

LeuAspProThrPheThrIleGluThrIleThrLeuProGlnAspAlaValSerArgThr
601 CCTTGACCCTACCTTCACCATTGAGACAATCACGCTCCCCCAGGATGCTGTCTCCCGCAC
    GGAACTGGGATGGAAGTGGTAACTCTGTTAGTGCGAGGGGGTCCTACGACAGAGGGCGTG

GlnArgArgGlyArgThrGlyArgGlyLysProGlyIleTyrArgPheValAlaProGly
661 TCAACGTCGGGGCAGGACTGGCAGGGGGAAGCCAGGCATCTACAGATTTGTGGCACCGGG
    AGTTGCAGCCCCGTCCTGACCGTCCCCCTTCGGTCCGTAGATGTCTAAACACCGTGGCCC

GluArgProSerGlyMetPheAspSerSerValLeuCysGluCysTyrAspAlaGlyCys
721 GGAGCGCCCCTCCGGCATGTTCGACTCGTCCGTCCTCTGTGAGTGCTATGACGCAGGCTG
    CCTCGCGGGGAGGCCGTACAAGCTGAGCAGGCAGGAGACACTCACGATACTGCGTCCGAC

AlaTrpTyrGluLeuThrProAlaGluThrThrValArgLeuArgAlaTyrMetAsnThr
781 TGCTTGGTATGAGCTCACGCCCGCCGAGACTACAGTTAGGCTACGAGCGTACATGAACAC
    ACGAACCATACTCGAGTGCGGGCGGCTCTGATGTCAATCCGATGCTCGCATGTACTTGTG

ProGlyLeuProValCysGlnAspHisLeuGluPheTrpGluGlyValPheThrGlyLeu
841 CCCGGGGCTTCCCGTGTGCCAGGACCATCTTGAATTTTGGGAGGGCGTCTTTACAGGCCT
    GGGCCCCGAAGGGCACACGGTCCTGGTAGAACTTAAAACCCTCCCGCAGAAATGTCCGGA
```

FIG. 14B

```
        ThrHisIleAspAlaHisPheLeuSerGlnThrLysGlnSerGlyGluAspLeuProTyr
 901 CACTCATATAGATGCCCACTTTCTATCCCAGACAAAGCAGAGTGGGGAGAACCTTCCTTA
     GTGAGTATATCTACGGGTGAAAGATAGGGTCTGTTTCGTCTCACCCCTCTTGGAAGGAAT

LeuValAlaTyrGlnAlaThrValCysAlaArgAlaGlnAlaProProProSerTrpAsp
 961 CCTGGTAGCGTACCAAGCCACCGTGTGCGCTAGGGCTCAAGCCCCTCCCCCATCGTGGGA
     GGACCATCGCATGGTTCGGTGGCACACGCGATCCCGAGTTCGGGGAGGGGGTAGCACCCT

GlnMetTrpLysCysLeuIleArgLeuLysProThrLeuHisGlyProThrProLeuLeu
1021 CCAGATGTGGAAGTGTTTGATTCGCCTCAAGCCCACCCTCCATGGGCCAACACCCCTGCT
     GGTCTACACCTTCACAAACTAAGCGGAGTTCGGGTGGGAGGTACCCGGTTGTGGGGACGA

TyrArgLeuGlyAlaValGlnAsnGluIleThrLeuThrHisProValThrLysTyrIle
1081 ATACAGACTGGGCGCTGTTCAGAATGAAATCACCCTGACGCACCCAGTCACCAAATACAT
     TATGTCTGACCCGCGACAAGTCTTACTTTAGTGGGACTGCGTGGGTCAGTGGTTTATGTA

MetThrCysMetSerAlaAspLeuGluValValThrSerThrTrpValLeuValGlyGly
1141 CATGACATGCATGTCGGCCGACCTGGAGGTCGTCACGAGCACCTGGGTGCTCGTTGGCGG
     GTACTGTACGTACAGCCGGCTGGACCTCCAGCAGTGCTCGTGGACCCACGAGCAACCGCC

ValLeuAlaAlaLeuAlaAlaTyrCysLeuSerThrGlyCysValValIleValGlyArg
1201 CGTCCTGGCTGCTTTGGCCGCGTATTGCCTGTCAACAGGCTGCGTGGTCATAGTGGGCAG
     GCAGGACCGACGAAACCGGCGCATAACGGACAGTTGTCCGACGCACCAGTATCACCCGTC

ValValLeuSerGlyLysProAlaIleIleProAspArgGluValLeuTyrArgGluPhe
1261 GGTCGTCTTGTCCGGGAAGCCGGCAATCATACCTGACAGGGAAGTCCTCTACCGAGAGTT
     CCAGCAGAACAGGCCCTTCGGCCGTTAGTATGGACTGTCCCTTCAGGAGATGGCTCTCAA

AspGluMetGluGluCysSerGlnHisLeuProTyrIleGluGlnGlyMetMetLeuAla
1321 CGATGAGATGGAAGAGTGCTCTCAGCACTTACCGTACATCGAGCAAGGGATGATGCTCGC
     GCTACTCTACCTTCTCACGAGAGTCGTGAATGGCATGTAGCTCGTTCCCTACTACGAGCG

GluGlnPheLysGlnLysAlaLeuGlyLeuLeuGlnThrAlaSerArgGlnAlaGluVal
1381 CGAGCAGTTCAAGCAGAAGGCCCTCGGCCTCCTGCAGACCGCGTCCCGTCAGGCAGAGGT
     GCTCGTCAAGTTCGTCTTCCGGGAGCCGGAGGACGTCTGGCGCAGGGCAGTCCGTCTCCA

IleAlaProAlaValGlnThrAsnTrpGlnLysLeuGluThrPheTrpAlaLysHisMet
1441 TATCGCCCCTGCTGTCCAGACCAACTGGCAAAAACTCGAGACCTTCTGGGCGAAGCATAT
     ATAGCGGGGACGACAGGTCTGGTTGACCGTTTTTGAGCTCTGGAAGACCCGCTTCGTATA

TrpAsnPheIleSerGlyIleGlnTyrLeuAlaGlyLeuSerThrLeuProGlyAsnPro
1501 GTGGAACTTCATCAGTGGGATACAATACTTGGCGGGCTTGTCAACGCTGCCTGGTAACCC
     CACCTTGAAGTAGTCACCCTATGTTATGAACCGCCCGAACAGTTGCGACGGACCATTGGG

AlaIleAlaSerLeuMetAlaPheThrAlaAlaValThrSerProLeuThrThrSerGln
1561 CGCCATTGCTTCATTGATGGCTTTTACAGCTGCTGTCACCAGCCCACTAACCACTAGCCA
     GCGGTAACGAAGTAACTACCGAAAATGTCGACGACAGTGGTCGGGTGATTGGTGATCGGT

ThrLeuLeuPheAsnIleLeuGlyGlyTrpValAlaAlaGlnLeuAlaAlaProGlyAla
1621 AACCCTCCTCTTCAACATATTGGGGGGGTGGGTGGCTGCCCAGCTCGCCGCCCCCGGTGC
     TTGGGAGGAGAAGTTGTATAACCCCCCACCCACCGACGGGTCGAGCGGCGGGGGCCACG

AlaThrAlaPheValGlyAlaGlyLeuAlaGlyAlaAlaIleGlySerValGlyLeuGly
1681 CGCTACTGCCTTTGTGGGCGCTGGCTTAGCTGGCGCCGCCATCGGCAGTGTTGGACTGGG
     GCGATGACGGAAACACCCGCGACCGAATCGACCGCGGCGGTAGCCGTCACAACCTGACCC
```

FIG. 14C

```
        LysValLeuIleAspIleLeuAlaGlyTyrGlyAlaGlyValAlaGlyAlaLeuValAla
1741 GAAGGTCCTCATAGACATCCTTGCAGGGTATGGCGCGGGCGTGGCGGGAGCTCTTGTGGC
     CTTCCAGGAGTATCTGTAGGAACGTCCCATACCGCGCCCGCACCGCCCTCGAGAACACCG

PheLysIleMetSerGlyGluValProSerThrGluAspLeuValAsnLeuLeuProAla
1801 ATTCAAGATCATGAGCGGTGAGGTCCCCTCCACGGAGGACCTGGTCAATCTACTGCCCGC
     TAAGTTCTAGTACTCGCCACTCCAGGGGAGGTGCCTCCTGGACCAGTTAGATGACGGGCG

IleLeuSerProGlyAlaLeuValValGlyValValCysAlaAlaIleLeuArgArgHis
1861 CATCCTCTCGCCCGGAGCCCTCGTAGTCGGCGTGGTCTGTGCAGCAATACTGCGCCGGCA
     GTAGGAGAGCGGGCCTCGGGAGCATCAGCCGCACCAGACACGTCGTTATGACGCGGCCGT

ValGlyProGlyGluGlyAlaValGlnTrpMetAsnArgLeuIleAlaPheAlaSerArg
1921 CGTTGGCCCGGGCGAGGGGGCAGTGCAGTGGATGAACCGGCTGATAGCCTTCGCCTCCCG
     GCAACCGGGCCCGCTCCCCGTCACGTCACCTACTTGGCCGACTATCGGAAGCGGAGGGC

GlyAsnHisValSerProThrHisTyrValProGluSerAspAlaAlaAlaArgValThr
1981 GGGGAACCATGTTTCCCCCACGCACTACGTGCCGGAGAGCGATGCAGCTGCCCGCGTCAC
     CCCCTTGGTACAAAGGGGGTGCGTGATGCACGGCCTCTCGCTACGTCGACGGGCGCAGTG

AlaIleLeuSerSerLeuThrValThrGlnLeuLeuArgArgLeuHisGlnTrpIleSer
2041 TGCCATACTCAGCAGCCTCACTGTAACCCAGCTCCTGAGGCGACTGCACCAGTGGATAAG
     ACGGTATGAGTCGTCGGAGTGACATTGGGTCGAGGACTCCGCTGACGTGGTCACCTATTC

SerGluCysThrThrProCysSerGlySerTrpLeuArgAspIleTrpAspTrpIleCys
2101 CTCGGAGTGTACCACTCCATGCTCCGGTTCCTGGCTAAGGGACATCTGGGACTGGATATG *
     GAGCCTCACATGGTGAGGTACGAGGCCAAGGACCGATTCCCTGTAGACCCTGACCTATAC

GluValLeuSerAspPheLysThrTrpLeuLysAlaLysLeuMetProGlnLeuProGly
2161 CGAGGTGTTGAGCGACTTTAAGACCTGGCTAAAAGCTAAGCTCATGCCACAGCTGCCTGG
     GCTCCACAACTCGCTGAAATTCTGGACCGATTTTCGATTCGAGTACGGTGTCGACGGACC

IleProPheValSerCysGlnArgGlyTyrLysGlyValTrpArgValAspGlyIleMet
2221 GATCCCCTTTGTGTCCTGCCAGCGCGGGTATAAGGGGGTCTGGCGAGTGGACGGCATCAT
     CTAGGGGAAACACAGGACGGTCGCGCCCATATTCCCCCAGACCGCTCACCTGCCGTAGTA

HisThrArgCysHisCysGlyAlaGluIleThrGlyHisValLysAsnGlyThrMetArg
2281 GCACACTCGCTGCCACTGTGGAGCTGAGATCACTGGACATGTCAAAAACGGGACGATGAG
     CGTGTGAGCGACGGTGACACCTCGACTCTAGTGACCTGTACAGTTTTTGCCCTGCTACTC

IleValGlyProArgThrCysArgAsnMetTrpSerGlyThrPheProIleAsnAlaTyr
2341 GATCGTCGGTCCTAGGACCTGCAGGAACATGTGGAGTGGGACCTTCCCCATTAATGCCTA
     CTAGCAGCCAGGATCCTGGACGTCCTTGTACACCTCACCCTGGAAGGGGTAATTACGGAT

ThrThrGlyProCysThrProLeuProAlaProAsnTyrThrPheAlaLeuTrpArgVal
2401 CACCACGGGCCCCTGTACCCCCCTTCCTGCGCCGAACTACACGTTCGCGCTATGGAGGGT
     GTGGTGCCCGGGGACATGGGGGGAAGGACGCGGCTTGATGTGCAAGCGCGATACCTCCCA

SerAlaGluGluTyrValGluIleArgGlnValGlyAspPheHisTyrValThrGlyMet
2461 GTCTGCAGAGGAATATGTGGAGATAAGGCAGGTGGGGGACTTCCACTACGTGACGGGTAT
     CAGACGTCTCCTTATACACCTCTATTCCGTCCACCCCCTGAAGGTGATGCACTGCCCATA

ThrThrAspAsnLeuLysCysProCysGlnValProSerProGluPhePheThrGlu
2521 GACTACTGACAATCTCAAATGCCCGTGCCAGGTCCCATCGCCCGAATTTTTCACAGAAT
     CTGATGACTGTTAGAGTTTACGGGCACGGTCCAGGGTAGCGGGCTTAAAAAGTGTCTTA
```

FIG. 15

```
        AlaValAspPheIleProValGluAsnLeuGluThrThrMetArgSerProValPheThr
  1 GGCGGTGGACTTTATCCCTGTGGAGAACCTAGAGACAACCATGAGGTCCCCGGTGTTCAC
    CCGCCACCTGAAATAGGGACACCTCTTGGATCTCTGTTGGTACTCCAGGGGCCACAAGTG

AspAsnSerSerProProValValProGlnSerPheGlnValAlaHisLeuHisAlaPro
 61 GGATAACTCCTCTCCACCAGTAGTGCCCCAGAGCTTCCAGGTGGCTCACCTCCATGCTCC
    CCTATTGAGGAGAGGTGGTCATCACGGGGTCTCGAAGGTCCACCGAGTGGAGGTACGAGG

ThrGlySerGlyLysSerThrLysValProAlaAlaTyrAlaAlaGlnGlyTyrLysVal
121 CACAGGCAGCGGCAAAAGCACCAAGGTCCCGGCTGCATATGCAGCTCAGGGCTATAAGGT
    GTGTCCGTCGCCGTTTTCGTGGTTCCAGGGCCGACGTATACGTCGAGTCCCGATATTCCA

LeuValLeuAsnProSerValAlaAlaThrLeuGlyPheGlyAlaTyrMetSerLysAla
181 GCTAGTACTCAACCCCTCTGTTGCTGCAACACTGGGCTTTGGTGCTTACATGTCCAAGGC
    CGATCATGAGTTGGGGAGACAACGACGTTGTGACCCGAAACCACGAATGTACAGGTTCCG

----------Overlap with 40b----------------------------------
        HisGlyIleAspProAsnIleArgThrGlyValArgThrIleThrThrGlySerProIle
241 TCATGGGATCGATCCTAACATCAGGACCGGGGTGAGAACAATTACCACTGGCAGCCCCAT
    AGTACCCTAGCTAGGATTGTAGTCCTGGCCCCACTCTTGTTAATGGTGACCGTCGGGGTA
    ------------------------------------------------------------
        ThrTyrSerThrTyrGlyLysPheLeuAlaAspGlyGlyCysSerGlyGlyAlaTyrAsp
301 CACGTACTCCACCTACGGCAAGTTCCTTGCCGACGGCGGGTGCTCGGGGGGCGCTTATGA
    GTGCATGAGGTGGATGCCGTTCAAGGAACGGCTGCCGCCCACGAGCCCCCCGCGAATACT
    ------------------------------------------------------------
        IleIleIleCysAspGluCysHisSerThrAspAlaThrSerIleLeuGlyIleGlyThr
361 CATAATAATTTGTGACGAGTGCCACTCCACGGATGCCACATCCATCTTGGGCATTGGCAC
    GTATTATTAAACACTGCTCACGGTGAGGTGCCTACGGTGTAGGTAGAACCCGTAACCGTG
    ------------------------------------------------------------
        ValLeuAspGlnAlaGluThrAlaGlyAlaArgLeuValValLeuAlaThrAlaThrPro
421 TGTCCTTGACCAAGCAGAGACTGCGGGGGCGAGACTGGTTGTGCTCGCCACCGCCACCCC
    ACAGGAACTGGTTCGTCTCTGACGCCCCGCTCTGACCAACACGAGCGGTGGCGGTGGGG
    ------------------------------------------------------------
        ProGlySerValThrValProHisProAsnIleGluGluValAlaLeuSerThrThrGly
481 TCCGGGCTCCGTCACTGTGCCCCATCCCAACATCGAGGAGGTTGCTCTGTCCACCACCGG
    AGGCCCGAGGCAGTGACACGGGGTAGGGTTGTAGCTCCTCCAACGAGACAGGTGGTGGCC
    ------------------------------------------------------------
        GluIleProPheTyrGlyLysAlaIleProLeuGluValIleLysGlyGlyArgHisLeu
541 AGAGATCCCTTTTTACGGCAAGGCTATCCCCCTCGAAGTAATCAAGGGGGGAGACATCT
    TCTCTAGGGAAAAATGCCGTTCCGATAGGGGGAGCTTCATTAGTTCCCCCCCTCTGTAGA
    ------------------------------------------------------------
        IlePheCysHisSerLysLysLysCysAspGluLeuAlaAlaLysLeuValAlaLeuGly
601 CATCTTCTGTCATTCAAAGAAGAAGTGCGACGAACTCGCCGCAAAGCTGGTCGCATTGGG
    GTAGAAGACAGTAAGTTTCTTCTTCACGCTGCTTGAGCGGCGTTTCGACCAGCGTAACCC
    ------------------------------------------------------------
        IleAsnAlaValAlaTyrTyrArgGlyLeuAspValSerValIleProThrSerGlyAsp
661 CATCAATGCCGTGGCCTACTACCGCGGTCTTGACGTGTCCGTCATCCCGACCAGCGGCGA
    GTAGTTACGGCACCGGATGATGGCGCCAGAACTGCACAGGCAGTAGGGCTGGTCGCCGCT ValValValValAlaThrAspAlaLeuMetThrGlyTyrThrGlyAspPheAspSerVal
721 TGTTGTCGTCGTGGCAACCGATGCCCTCATGACCGGCTATACCGGCGACTTCGACTCGGT
    ACAACAGCAGCACCGTTGGCTACGGGAGTACTGGCCGATATGGCCGCTGAAGCTGAGCCA IleAspCysAsnThrCys
781 GATAGACTGCAATACGTGTG
    CTATCTGACGTTATGCACAC
```

FIG. 16

```
      ProCysThrCysGlySerSerAspLeuTyrLeuValThrArgHisAlaAspValIlePro
  1   CTCCCTGCACTTGCGGCTCCTCGGACCTTTACCTGGTCACGAGGCACGCCGATGTCATTC
      GAGGGACGTGAACGCCGAGGAGCCTGGAAATGGACCAGTGCTCCGTGCGGCTACAGTAAG

ValArgArgArgGlyAspSerArgGlySerLeuLeuSerProArgProIleSerTyrLeu
 61   CCGTGCGCCGGCGGGGTGATAGCAGGGGCAGCCTGCTGTCGCCCCGGCCCATTTCCTACT
      GGCACGCGGCCGCCCCACTATCGTCCCCGTCGGACGACAGCGGGGCCGGGTAAAGGATGA

LysGlySerSerGlyGlyProLeuLeuCysProAlaGlyHisAlaValGlyIlePheArg
121   TGAAAGGCTCCTCGGGGGGTCCGCTGTTGTGCCCCGCGGGGCACGCCGTGGGCATATTTA
      ACTTTCCGAGGAGCCCCCCAGGCGACAACACGGGGCGCCCCGTGCGGCACCCGTATAAAT

-----------------Overlap with
      AlaAlaValCysThrArgGlyValAlaLysAlaValAspPheIleProValGluAsnLeu
181   GGGCCGCGGTGTGCACCCGTGGAGTGGCTAAGGCGGTGGACTTTATCCCTGTGGAGAACC
      CCCGGCGCCACACGTGGGCACCTCACCGATTCCGCCACCTGAAATAGGGACACCTCTTGG 33c------------------------------------
      GluThrThrMetArgSerProValPheThrAspAsnSer
241   TAGAGACAACCATGAGGTCCCCGGTGTTCACGGATAACTCCTC
      ATCTCTGTTGGTACTCCAGGGGCCACAAGTGCCTATTGAGGAG
```

FIG. 17

```
      GlyTrpArgLeuLeuAlaProIleThrAlaTyrAlaGlnGlnThrArgGlyLeuLeuGly
  1   GGGGTGGAGGTTGCTGGCGCCCATCACGGCGTACGCCCAGCAGACAAGGGGCCTCCTAGG
      CCCCACCTCCAACGACCGCGGGTAGTGCCGCATGCGGGTCGTCTGTTCCCCGGAGGATCC

CysIleIleThrSerLeuThrGlyArgAspLysAsnGlnValGluGlyGluValGlnIle
 61   GTGCATAATCACCAGCCTAACTGGCCGGGACAAAAACCAAGTGGAGGGTGAGGTCCAGAT
      CACGTATTAGTGGTCGGATTGACCGGCCCTGTTTTTGGTTCACCTCCCACTCCAGGTCTA

ValSerThrAlaAlaGlnThrPheLeuAlaThrCysIleAsnGlyValCysTrpThrVal
121   TGTGTCAACTGCTGCCCAAACCTTCCTGGCAACGTGCATCAATGGGGTGTGCTGGACTGT
      ACACAGTTGACGACGGGTTTGGAAGGACCGTTGCACGTAGTTACCCCACACGACCTGACA

TyrHisGlyAlaGlyThrArgThrIleAlaSerProLysGlyProValIleGlnMetTyr
181   CTACCACGGGGCCGGAACGAGGACCATCGCGTCACCCAAGGGTCCTGTCATCCAGATGTA
      GATGGTGCCCCGGCCTTGCTCCTGGTAGCGCAGTGGGTTCCCAGGACAGTAGGTCTACAT

ThrAsnValAspGlnAspLeuValGlyTrpProAlaProGlnGlySerArgSerLeuThr
241   TACCAATGTAGACCAAGACCTTGTGGGCTGGCCCGCTCCGCAAGGTAGCCGCTCATTGAC
      ATGGTTACATCTGGTTCTGGAACACCCGACCGGGCGAGGCGTTCCATCGGCGAGTAACTG

----------Overlap with 8h----------------------
      ProCysThrCysGlySerSerAspLeuTyrLeuValThrArgHis
301   ACCCTGCACTTGCGGCTCCTCGGACCTTTACCTGGTCACGAGGCACG
      TGGGACGTGAACGCCGAGGAGCCTGGAAATGGACCAGTGCTCCGTGC
```

FIG. 18

```
    ------------------------------------------------------------
      AsnMetTrpSerGlyThrPheProIleAsnAlaTyrThrThrGlyProCysThrProLeu
  1 GAACATGTGGAGTGGGACCTTCCCCATTAATGCCTACACCACGGGCCCCTGTACCCCCCT
    CTTGTACACCTCACCCTGGAAGGGGTAATTACGGATGTGGTGCCCGGGGACATGGGGGGA

---------------Overlap with 25c-----------------------------
      ProAlaProAsnTyrThrPheAlaLeuTrpArgValSerAlaGluGluTyrValGluIle
 61 TCCTGCGCCGAACTACACGTTCGCGCTATGGAGGGTGTCTGCAGAGGAATACGTGGAGAT
    AGGACGCGGCTTGATGTGCAAGCGCGATACCTCCCACAGACGTCTCCTTATGCACCTCTA
    ------------------------------------
      ArgGlnValGlyAspPheHisTyrValThrGlyMetThrThrAspAsnLeuLysCysPro
121 AAGGCAGGTGGGGGACTTCCACTACGTGACGGGTATGACTACTGACAATCTTAAATGCCC
    TTCCGTCCACCCCCTGAAGGTGATGCACTGCCCATACTGATGACTGTTAGAATTTACGGG
    ------------------------------------
      CysGlnValProSerProGluPhePheThrGluLeuAspGlyValArgLeuHisArgPhe
181 GTGCCAGGTCCCATCGCCCGAATTTTTCACAGAATTGGACGGGGTGCGCCTACATAGGTT
    CACGGTCCAGGGTAGCGGGCTTAAAAAGTGTCTTAACCTGCCCCACGCGGATGTATCCAA AlaProProCysLysProLeuLeuArgGluGluValSerPheArgValGlyLeuHisGlu
241 TGCGCCCCCCTGCAAGCCCTTGCTGCGGGAGGAGGTATCATTCAGAGTAGGACTCCACGA
    ACGCGGGGGGACGTTCGGGAACGACGCCCTCCTCCATAGTAAGTCTCATCCTGAGGTGCT TyrProValGlySerGlnLeuProCysGluProGluProAspValAlaValLeuThrSer
301 ATACCCGGTAGGGTCGCAATTACCTTGCGAGCCCGAACCGGACGTGGCCGTGTTGACGTC
    TATGGGCCATCCCAGCGTTAATGGAACGCTCGGGCTTGGCCTGCACCGGCACAACTGCAG MetLeuThrAspProSerHisIleThrAlaGluAlaAlaGlyArgArgLeuAlaArgGly
361 CATGCTCACTGATCCCTCCCATATAACAGCAGAGGCGGCCGGGCGAAGGTTGGCGAGGGG
    GTACGAGTGACTAGGGAGGGTATATTGTCGTCTCCGCCGGCCCGCTTCCAACCGCTCCCC SerProProSerValAlaSerSerSerAlaSerGlnLeuSerAlaProSerLeuLysAla
421 ATCACCCCCCTCTGTGGCCAGCTCCTCGGCTAGCCAGCTATCCGCTCCATCTCTCAAGGC
    TAGTGGGGGGAGACACCGGTCGAGGAGCCGATCGGTCGATAGGCGAGGTAGAGAGTTCCG ThrCysThrAlaAsnHisAspSerProAsp
481 AACTTGCACCGCTAACCATGACTCCCCTGAT
    TTGAACGTGGCGATTGGTACTGAGGGGACTA
```

FIG. 19

```
                                    ------Overlap with 14c------
    SerSerSerAlaSerGlnLeuSerAlaProSerLeuLysAlaThrCysThrAlaAspHis
  1 AGCTCCTCGGCTAGCCAGCTATCCGCTCCATCTCTCAAGGCAACTTGCACCGCTAACCAT
    TCGAGGAGCCGATCGGTCGATAGGCGAGGTAGAGAGTTCCGTTGAACGTGGCGATTGGTA
    ------------
    AspSerProAspAlaGluLeuIleGluAlaAsnLeuLeuTrpArgGlnGluMetGlyGlu
 61 GACTCCCCTGATGCTGAGCTCATAGAGGCCAACCTCCTATGGAGGCAGGAGATGGGCGGC
    CTGAGGGGACTACGACTCGAGTATCTCCGGTTGGAGGATACCTCCGTCCTCTACCCGCCG AsnIleThrArgValGluSerGluAsnLysValValIleLeuAspSerPheAspProLeu
121 AACATCACCAGGGTTGAGTCAGAAAACAAAGTGGTGATTCTGGACTCCTTCGATCCGCTT
    TTGTAGTGGTCCCAACTCAGTCTTTTGTTTCACCACTAAGACCTGAGGAAGCTAGGCGAA ValAlaGluGluAspGluArgGluIleSerValProAlaGluIleLeuArgLysSerArg
181 GTGGCGGAGGAGGACGAGCGGGAGATCTCCGTACCCGCAGAAATCCTGCGGAAGTCTCGG
    CACCGCCTCCTCCTGCTCGCCCTCTAGAGGCATGGGCGTCTTTAGGACGCCTTCAGAGCC ArgPheAlaGlnAlaLeuProValTrpAlaArgProAspTyrAsnProProLeuValGlu
241 AGATTCGCCCAGGCCCTGCCCGTTTGGGCGCGGCCGGACTATAACCCCCCGCTAGTGGAG
    TCTAAGCGGGTCCGGGACGGGCAAACCCGCGCCGGCCTGATATTGGGGGCGATCACCTC ThrTrpLysLysProAspTyrGluProProValValHisGlyCysProLeuProProPro
301 ACGTGGAAAAAGCCCGACTACGAACCACCTGTGGTCCATGGCTGTCCGCTTCCACCTCCA
    TGCACCTTTTTCGGGCTGATGCTTGGTGGACACCAGGTACCGACAGGCGAAGGTGGAGGT LysSerProProValPro
361 AAGTCCCCTCCTGTGCCG
    TTCAGGGGAGGACACGGC
```

FIG. 20

```
    ------------------------------------------
    ValTrpAlaArgProAspTyrAsnProProLeuValGluThrTrpLysLysProAspTyr
  1 CGTTTGGGCGCGGCCGGACTATAACCCCCCGCTAGTGGAGACGTGGAAAAAACCCGACTA
    GCAAACCCGCGCCGGCCTGATATTGGGGGGCGATCACCTCTGCACCTTTTTTGGGCTGAT

-----------------Overlap with 8f--------------------------
    GluProProValValHisGlyCysProLeuProProProLysSerProProValProPro
 61 CGAACCACCTGTGGTCCATGGCTGCCCGCTTCCACCTCCAAAGTCCCCTCCTGTGCCTCC
    GCTTGGTGGACACCAGGTACCGACGGGCGAAGGTGGAGGTTTCAGGGGAGGACACGGAGG ProArgLysLysArgThrValValLeuThrGluSerThrLeuSerThrAlaLeuAlaGlu
121 GCCTCGGAAGAAGCGGACGGTGGTCCTCACTGAATCAACCCTATCTACTGCCTTGGCCGA
    CGGAGCCTTCTTCGCCTGCCACCAGGAGTGACTTAGTTGGGATAGATGACGGAACCGGCT LeuAlaThrArgSerPheGlySerSerSerThrSerGlyIleThrGlyAspAsnThrThr
181 GCTCGCCACCAGAAGCTTTGGCAGCTCCTCAACTTCCGGCATTACGGGCGACAATACGAC
    CGAGCGGTGGTCTTCGAAACCGTCGAGGAGTTGAAGGCCGTAATGCCCGCTGTTATGCTG ThrSerSerGluProAlaProSerGlyCysProProAspSerAspAlaGluSerPhe
241 AACATCCTCTGAGCCCGCCCCTTCTGGCTGCCCCCCCGACTCCGACGCTGAGTCCTTTGC
    TTGTAGGAGACTCGGGCGGGGAAGACCGACGGGGGGGCTGAGGCTGCGACTCAGGAAACG
```

FIG. 21

```
        AlaSerArgSerPheGlySerSerSerThrSerGlyIleThrGlyAspAsnThrThrThr
  1 GCCTCCAGAAGCTTTGGCAGCTCCTCAACTTCCGGCATTACGGGCGACAATACGACAACA
    CGGAGGTCTTCGAAACCGTCGAGGAGTTGAAGGCCGTAATGCCCGCTGTTATGCTGTTGT

--------------Overlap with 33f----------------------
        SerSerGluProAlaProSerGlyCysProProAspSerAspAlaGluSerTyrSerSer
 61 TCCTCTGAGCCCGCCCCTTCTGGCTGCCCCCCCGACTCCGACGCTGAGTCCTATTCCTCC
    AGGAGACTCGGGCGGGGAAGACCGACGGGGGGGCTGAGGCTGCGACTCAGGATAAGGAGG MetProProLeuGluGlyGluProGlyAspProAspLeuSerAspGlySerTrpSerThr
121 ATGCCCCCCCTGGAGGGGGAGCCTGGGGATCCGGATCTTAGCGACGGGTCATGGTCAACG
    TACGGGGGGGACCTCCCCCTCGGACCCCTAGGCCTAGAATCGCTGCCCAGTACCAGTTGC ValSerSerGluAlaAsnAlaGluAspValValCysCysSerMetSerTyrSerTrpThr
181 GTCAGTAGTGAGGCCAACGCGGAGGATGTCGTGTGCTGCTCAATGTCTTACTCTTGGACA
    CAGTCATCACTCCGGTTGCGCCTCCTACAGCACACGACGAGTTACAGAATGAGAACCTGT GlyAlaLeuValThrProCysAlaAlaGluGluGlnLysLeuProIleAsnAlaLeuSer
241 GGCGCACTCGTCACCCCGTGCGCCGCGGAAGAACAGAAACTGCCCATCAATGCACTAAGC
    CCGCGTGAGCAGTGGGGCACGCGGCGCCTTCTTGTCTTTGACGGGTAGTTACGTGATTCG AsnSerLeuLeuArgHisHisAsnLeuValTyrSerThrThrSerArgSer
301 AACTCGTTGCTACGTCACCACAATTTGGTGTATTCCACCACCTCACGCAGTG
    TTGAGCAACGATGCAGTGGTGTTAAACCACATAAGGTGGTGGAGTGCGTCAC
```

FIG. 22

```
        GlyThrTyrValTyrAsnHisLeuThrProLeuArgAspTrpAlaHisAsnGlyLeuArg
  1 GGCACCTATGTTTATAACCATCTGACTCCTCTTCGGGACTGGGCGCACAACGGCTTGCGA
    CCGTGGATACAAATATTGGTAGAGTGAGGAGAAGCCCTGACCCGCGTGTTGCCGAACGCT

AspLeuAlaValAlaValGluProValValPheSerGlnMetGluThrLysLeuIleThr
 61 GATCTGGCCGTGGCTGTAGAGCCAGTCGTCTTCTCCCAAATGGAGACCAAGCTCATCACG
    CTAGACCGGCACCGACATCTCGGTCAGCAGAAGAGGGTTTACCTCTGGTTCGAGTAGTGC

TrpGlyAlaAspThrAlaAlaCysGlyAspIleIleAsnGlyLeuProValSerAlaArg
121 TGGGGGGCAGATACCGCCGCGTGCGGTGACATCATCAACGGCTTGCCTGTTTCCGCCCGC
    ACCCCCCGTCTATGGCGGCGCACGCCACTGTAGTAGTTGCCGAACGGACAAAGGCGGGCG

---------------
        ArgGlyArgGluIleLeuLeuGlyProAlaAspGlyMetValSerLysGlyTrpArgLeu
181 AGGGGCCGGGAGATACTGCTCGGGCCAGCCGATGGAATGGTCTCCAAGGGTTGGAGGTTG
    TCCCCGGCCCTCTATGACGAGCCCGGTCGGCTACCTTACCAGAGGTTCCCAACCTCCAAC

LeuAlaProIleThrAlaTyrAlaGlnGlnThrArgGlyLeuLeuGlyCysIleIleThr
241 CTGGCGCCCATCACGGCGTACGCCCAGCAGACAAGGGGCCTCCTAGGGTGCATAATCACC
    GACCGCGGGTAGTGCCGCATGCGGGTCGTCTGTTCCCCGGAGGATCCCACGTATTAGTGG

-----------------Overlap with 7e---------------------------
        SerLeuThrGlyArgAspLysAsnGlnValGluGlyGluValGlnIleValSerThrAla
301 AGCCTAACTGGCCGGGACAAAAACCAAGTGGAGGGTGAGGTCCAGATTGTGTCAACTGCT
    TCGGATTGACCGGCCCTGTTTTTGGTTCACCTCCCACTCCAGGTCTAACACAGTTGACGA ---------------------------------------------
        AlaGlnThrPheLeuAlaThrCysIleAsnGlyValCysTrp
361 GCCCAAACCTTCCTGGCAACGTGCATCAATGGGGTGTGCTGG
    CGGGTTTGGAAGGACCGTTGCACGTAGTTACCCCACACGACC
```

FIG. 23

```
    GlyGlyValValLeuValGlyLeuMetAlaLeuThrLeuSerProTyrTyrLysArgTyr
  1 GGCGGTGTTGTTCTCGTCGGGTTGATGGCGCTGACTCTGTCACCATATTACAAGCGCTAT
    CCGCCACAACAAGAGCAGCCCAACTACCGCGACTGAGACAGTGGTATAATGTTCGCGATA

IleSerTrpCysLeuTrpTrpLeuGlnTyrPheLeuThrArgValGluAlaGlnLeuHis
 61 ATCAGCTGGTGCTTGTGGTGGCTTCAGTATTTTCTGACCAGAGTGGAAGCGCAACTGCAC
    TAGTCGACCACGAACACCACCGAAGTCATAAAAGACTGGTCTCACCTTCGCGTTGACGTG

ValTrpIleProProLeuAsnValArgGlyGlyArgAspAlaValIleLeuLeuMetCys
121 GTGTGGATTCCCCCCCTCAACGTCCGAGGGGGCGCGACGCCGTCATCTTACTCATGTGT
    CACACCTAAGGGGGGGAGTTGCAGGCTCCCCCGCGCTGCGGCAGTAGAATGAGTACACA

AlaValHisProThrLeuValPheAspIleThrLysLeuLeuLeuAlaValPheGlyPro
181 GCTGTACACCCGACTCTGGTATTTGACATCACCAAATTGCTGCTGGCCGTCTTCGGACCC
    CGACATGTGGGCTGAGACCATAAACTGTAGTGGTTTAACGACGACCGGCAGAAGCCTGGG

LeuTrpIleLeuGlnAlaSerLeuLeuLysValProTyrPheValArgValGlnGlyLeu
241 CTTTGGATTCTTCAAGCCAGTTTGCTTAAAGTACCCTACTTTGTGCGCGTCCAAGGCCTT
    GAAACCTAAGAAGTTCGGTCAAACGAATTTCATGGGATGAAACACGCGCAGGTTCCGGAA

LeuArgPheCysAlaLeuAlaArgLysMetIleGlyGlyHisTyrValGlnMetValIle
301 CTCCGGTTCTGCGCGTTAGCGCGGAAGATGATCGGAGGCCATTACGTGCAAATGGTCATC
    GAGGCCAAGACGCGCAATCGCGCCTTCTACTAGCCTCCGGTAATGCACGTTTACCAGTAG
    ------------------------------------------------------------
    IleLysLeuGlyAlaLeuThrGlyThrTyrValTyrAsnHisLeuThrProLeuArgAsp
361 ATTAAGTTAGGGGCGCTTACTGGCACCTATGTTTATAACCATCTCACTCCTCTTCGGGAC
    TAATTCAATCCCCGCGAATGACCGTGGATACAAATATTGGTAGAGTGAGGAGAAGCCCTG

-------------------Overlap with 7f ------------------------
    TrpAlaHisAsnGlyLeuArgAspLeuAlaValAlaValGluProValValPheSerGln
421 TGGGCGCACAACGGCTTGCGAGATCTGGCCGTGGCTGTAGAGCCAGTCGTCTTCTCCCAA
    ACCCGCGTGTTGCCGAACGCTCTAGACCGGCACCGACATCTCGGTCAGCAGAAGAGGGTT ----------------------------------------
    MetGluThrLysLeuIleThrTrpGly
481 ATGGAGACCAAGCTCATCACGTGGGGGGC
    TACCTCTGGTTCGAGTAGTGCACCCCCG
```

FIG. 24

```
        GluTyrValValLeuLeuPheLeuLeuLeuAlaAspAlaArgValCysSerCysLeuTrp
  1  GGGAGTACGTCGTTCTCCTGTTCCTTCTGCTTGCAGACGCGCGCGTCTGCTCCTGCTTGT
     CCCTCATGCAGCAAGAGGACAAGGAAGACGAACGTCTGCGCGCGCAGACGAGGACGAACA

MetMetLeuLeuIleSerGlnAlaGluAlaAlaLeuGluAsnLeuValIleLeuAsnAla
 61  GGATGATGCTACTCATATCCCAAGCGGAGGCGGCTTTGGAGAACCTCGTAATACTTAATG
     CCTACTACGATGAGTATAGGGTTCGCCTCCGCCGAAACCTCTTGGAGCATTATGAATTAC

AlaSerLeuAlaGlyThrHisGlyLeuValSerPheLeuValPhePheCysPheAlaTrp
121  CAGCATCCCTGGCCGGGACGCACGGTCTTGTATCCTTCCTCGTGTTCTTCTGCTTTGCAT
     GTCGTAGGGACCGGCCCTGCGTGCCAGAACATAGGAAGGAGCACAAGAAGACGAAACGTA

TyrLeuLysGlyLysTrpValProGlyAlaValTyrThrPheTyrGlyMetTrpProLeu
181  GGTATTTGAAGGGTAAGTGGGTGCCCGGAGCGGTCTACACCTTCTACGGGATGTGGCCTC
     CCATAAACTTCCCATTCACCCACGGGCCTCGCCAGATGTGGAAGATGCCCTACACCGGAG

LeuLeuLeuLeuLeuAlaLeuProGlnArgAlaTyrAlaLeuAspThrGluValAlaAla
241  TCCTCCTGCTCCTGTTGGCGTTGCCCCAGCGGGCGTACGCGCTGGACACGGAGGTGGCCG
     AGGAGGACGAGGACAACCGCAACGGGGTCGCCCGCATGCGCGACCTGTGCCTCCACCGGC

------------------Overlap with 11b-----------------
        SerCysGlyGlyValValLeuValGlyLeuMetAlaLeuThrLeuSerProTyrTyrLys
301  CGTCGTGTGGCGGTGTTGTTCTCGTCGGGTTGATGGCGCTGACTCTGTCACCATATTACA
     GCAGCACACCGCCACAACAAGAGCAGCCCAACTACCGCGACTGAGACAGTGGTATAATGT
     ----------------------------------------------------------------
        ArgTyrIleSerTrpCysLeuTrpTrpLeuGln
361  AGCGCTATATCAGCTGGTGCTTGTGGTGGCTTCAGAA
     TCGCGATATAGTCGACCACGAACACCACCGAAGTCTT
```

FIG. 25

```
     ----------------------------------------------------------------
        ProAlaProSerGlyCysProProAspSerAspAlaGluSerTyrSerSerMetProPro
  1  CCAGCCCCTTCTGGCTGCCCCCCCGACTCCGACGCTGAGTCCTATTCCTCCATGCCCCCC
     GGTCGGGGAAGACCGACGGGGGGGCTGAGGCTGCGACTCAGGATAAGGAGGTACGGGGGG
     ----------------------------------------------------------------
        LeuGluGlyGluProGlyAspProAspLeuSerAspGlySerTrpSerThrValSerSer
 61  CTGGAGGGGGAGCCTGGGGATCCGGATCTTAGCGACGGGTCATGGTCAACAGTCAGTAGT
     GACCTCCCCCTCGGACCCCTAGGCCTAGAATCGCTGCCCAGTACCAGTTGTCAGTCATCA

-----------------Overlap with 33g---------------
        GluAlaAsnAlaGluAspValValCysCysSerMetSerTyrSerTrpThrGlyAlaLeu
121  GAGGCCAACGCGGAGGATGTCGTGTGCTGCTCAATGTCCTACTCTTGGACAGGCGCACTC
     CTCCGGTTGCGCCTCCTACAGCACACGACGAGTTACAGGATGAGAACCTGTCCGCGTGAG
     ----------------------------------------------------------------
        ValThrProCysAlaAlaGluGluGlnLysLeuProIleAsnAlaLeuSerAsnSerLeu
181  GTCACCCCGTGCGCCGCGGAAGAACAGAAACTGCCCATCAATGCACTGAGCAACTCGTTG
     CAGTGGGGCACGCGGCGCCTTCTTGTCTTTGACGGGTAGTTACGTGACTCGTTGAGCAAC
     ----------------------------------------------------------------
        LeuArgHisHisAsnLeuValTyrSerThrThrSerArgSerAlaCysGlnArgGlnLys
241  CTACGTCACCACAATTTGGTGTATTCCACCACCTCACGCAGTGCTTGCCAAAGGCAGAAG
     GATGCAGTGGTGTTAAACCACATAAGGTGGTGGAGTGCGTCACGAACGGTTTCCGTCTTC LysValThrPheAspArgLeuGlnValLeuAspSerHisTyrGlnAspValLeuLysGly
301  AAAGTCACATTTGACAGACTGCAAGTTCTGGACAGCCATTACCAGGACGTACTCAAGGAG
     TTTCAGTGTAAACTGTCTGACGTTCAAGACCTGTCGGTAATGGTCCTGCATGAGTTCCTC ValLysAlaAlaAlaSerLysValLysAlaAsnPhe
361  GTTAAAGCAGCGGCGTCAAAAGTGAAGGCTAACTTC
     CAATTTCGTCGCCGCAGTTTTCACTTCCGATTGAAG
```

FIG. 26A

```
        GluTyrValValLeuLeuPheLeuLeuLeuAlaAspAlaArgValCysSerCysLeuTrp
  1 GGGAGTACGTCGTTCTCCTGTTCCTTCTGCTTGCAGACGCGCGTCTGCTCCTGCTTGT
    CCCTCATGCAGCAAGAGGACAAGGAAGACGAACGTCTGCGCGCGCAGACGAGGACGAACA

MetMetLeuLeuIleSerGlnAlaGluAlaAlaLeuGluAsnLeuValIleLeuAsnAla
 61 GGATGATGCTACTCATATCCCAAGCGGAGGCGGCTTTGGAGAACCTCGTAATACTTAATG
    CCTACTACGATGAGTATAGGGTTCGCCTCCGCCGAAACCTCTTGGAGCATTATGAATTAC

AlaSerLeuAlaGlyThrHisGlyLeuValSerPheLeuValPhePheCysPheAlaTrp
121 CAGCATCCCTGGCCGGGACGCACGGTCTTGTATCCTTCCTCGTGTTCTTCTGCTTTGCAT
    GTCGTAGGGACCGGCCCTGCGTGCCAGAACATAGGAAGGAGCACAAGAAGACGAAACGTA

TyrLeuLysGlyLysTrpValProGlyAlaValTyrThrPheTyrGlyMetTrpProLeu
181 GGTATTTGAAGGGTAAGTGGGTGCCCGGAGCGGTCTACACCTTCTACGGGATGTGGCCTC
    CCATAAACTTCCCATTCACCCACGGGCCTCGCCAGATGTGGAAGATGCCCTACACCGGAG

LeuLeuLeuLeuLeuAlaLeuProGlnArgAlaTyrAlaLeuAspThrGluValAlaAla
241 TCCTCCTGCTCCTGTTGGCGTTGCCCCAGCGGGCGTACGCGCTGGACACGGAGGTGGCCG
    AGGAGGACGAGGACAACCGCAACGGGGTCGCCCGCATGCGCGACCTGTGCCTCCACCGGC

SerCysGlyGlyValValLeuValGlyLeuMetAlaLeuThrLeuSerProTyrTyrLys
301 CGTCGTGTGGCGGTGTTGTTCTCGTCGGGTTGATGGCGCTGACTCTGTCACCATATTACA
    GCAGCACACCGCCACAACAAGAGCAGCCCAACTACCGCGACTGAGACAGTGGTATAATGT

ArgTyrIleSerTrpCysLeuTrpTrpLeuGlnTyrPheLeuThrArgValGluAlaGln
361 AGCGCTATATCAGCTGGTGCTTGTGGTGGCTTCAGTATTTTCTGACCAGAGTGGAAGCGC
    TCGCGATATAGTCGACCACGAACACCACCGAAGTCATAAAAGACTGGTCTCACCTTCGCG

LeuHisValTrpIleProProLeuAsnValArgGlyGlyArgAspAlaValIleLeuLeu
421 AACTGCACGTGTGGATTCCCCCCCTCAACGTCCGAGGGGGGCGCGACGCCGTCATCTTAC
    TTGACGTGCACACCTAAGGGGGGGAGTTGCAGGCTCCCCCCGCGCTGCGGCAGTAGAATG

MetCysAlaValHisProThrLeuValPheAspIleThrLysLeuLeuLeuAlaValPhe
481 TCATGTGTGCTGTACACCCGACTCTGGTATTTGACATCACCAAATTGCTGCTGGCCGTCT
    AGTACACACGACATGTGGGCTGAGACCATAAACTGTAGTGGTTTAACGACGACCGGCAGA

GlyProLeuTrpIleLeuGlnAlaSerLeuLeuLysValProTyrPheValArgValGln
541 TCGGACCCCTTTGGATTCTTCAAGCAGTTTGCTTAAAGTACCCTACTTTGTGCGCGTCC
    AGCCTGGGGAAACCTAAGAAGTTCGTCAAACGAATTTCATGGGATGAAACACGCGCAGG

GlyLeuLeuArgPheCysAlaLeuAlaArgLysMetIleGlyGlyHisTyrValGlnMet
601 AAGGCCTTCTCCGGTTCTGCGCGTTAGCGCGGAAGATGATCGGAGGCCATTACGTGCAAA
    TTCCGGAAGAGGCCAAGACGCGCAATCGCGCCTTCTACTAGCCTCCGGTAATGCACGTTT

ValIleIleLysLeuGlyAlaLeuThrGlyThrTyrValTyrAsnHisLeuThrProLeu
661 TGGTCATCATTAAGTTAGGGGCGCTTACTGGCACCTATGTTTATAACCATCTCACTCCTC
    ACCAGTAGTAATTCAATCCCCGCGAATGACCGTGGATACAAATATTGGTAGAGTGAGGAG

ArgAspTrpAlaHisAsnGlyLeuArgAspLeuAlaValAlaValGluProValValPhe
721 TTCGGGACTGGGCGCACAACGGCTTGCGAGATCTGGCCGTGGCTGTAGAGCCAGTCGTCT
    AAGCCCTGACCCGCGTGTTGCCGAACGCTCTAGACCGGCACCGACATCTCGGTCAGCAGA

SerGlnMetGluThrLysLeuIleThrTrpGlyAlaAspThrAlaAlaCysGlyAspIle
781 TCTCCCAAATGGAGACCAAGCTCATCACGTGGGGGGCAGATACCGCCGCGTGCGGTGACA
    AGAGGGTTTACCTCTGGTTCGAGTAGTGCACCCCCCGTCTATGGCGGCGCACGCCACTGT

IleAsnGlyLeuProValSerAlaArgArgGlyArgGluIleLeuLeuGlyProAlaAsp
841 TCATCAACGGCTTGCCTGTTTCCGCCCGCAGGGGCCGGGAGATACTGCTCGGGCCAGCCG
    AGTAGTTGCCGAACGGACAAAGGCGGGCGTCCCCGGCCCTCTATGACGAGCCCGGTCGGC

GlyMetValSerLysGlyTrpArgLeuLeuAlaProIleThrAlaTyrAlaGlnGlnThr
901 ATGGAATGGTCTCCAAGGGGTGGAGGTTGCTGGCGCCCATCACGGCGTACGCCCAGCAGA
    TACCTTACCAGAGGTTCCCCACCTCCAACGACCGCGGGTAGTGCCGCATGCGGGTCGTCT
```

FIG. 26B

```
       ArgGlyLeuLeuGlyCysIleIleThrSerLeuThrGlyArgAspLysAsnGlnValGlu
 961   CAAGGGGCCTCCTAGGGTGCATAATCACCAGCCTAACTGGCCGGGACAAAAACCAAGTGG
       GTTCCCCGGAGGATCCCACGTATTAGTGGTCGGATTGACCGGCCCTGTTTTTGGTTCACC

GlyGluValGlnIleValSerThrAlaAlaGlnThrPheLeuAlaThrCysIleAsnGly
1021   AGGGTGAGGTCCAGATTGTGTCAACTGCTGCCCAAACCTTCCTGGCAACGTGCATCAATG
       TCCCACTCCAGGTCTAACACAGTTGACGACGGGTTTGGAAGGACCGTTGCACGTAGTTAC

ValCysTrpThrValTyrHisGlyAlaGlyThrArgThrIleAlaSerProLysGlyPro
1081   GGGTGTGCTGGACTGTCTACCACGGGGCCGGAACGAGGACCATCGCGTCACCCAAGGGTC
       CCCACACGACCTGACAGATGGTGCCCCGGCCTTGCTCCTGGTAGCGCAGTGGGTTCCCAG

ValIleGlnMetTyrThrAsnValAspGlnAspLeuValGlyTrpProAlaProGlnGly
1141   CTGTCATCCAGATGTATACCAATGTAGACCAAGACCTTGTGGGCTGGCCCGCTCCGCAAG
       GACAGTAGGTCTACATATGGTTACATCTGGTTCTGGAACACCCGACCGGGCGAGGCGTTC

SerArgSerLeuThrProCysThrCysGlySerSerAspLeuTyrLeuValThrArgHis
1201   GTAGCCGCTCATTGACACCCTGCACTTGCGGCTCCTCGGACCTTTACCTGGTCACGAGGC
       CATCGGCGAGTAACTGTGGGACGTGAACGCCGAGGAGCCTGGAAATGGACCAGTGCTCCG

AlaAspValIleProValArgArgArgGlyAspSerArgGlySerLeuLeuSerProArg
1261   ACGCCGATGTCATTCCCGTGCGCCGGCGGGGTGATAGCAGGGGCAGCCTGCTGTCGCCCC
       TGCGGCTACAGTAAGGGCACGCGGCCGCCCCACTATCGTCCCCGTCGGACGACAGCGGGG

ProIleSerTyrLeuLysGlySerSerGlyGlyProLeuLeuCysProAlaGlyHisAla
1321   GGCCCATTTCCTACTTGAAAGGCTCCTCGGGGGGTCCGCTGTTGTGCCCCGCGGGGCACG
       CCGGGTAAAGGATGAACTTTCCGAGGAGCCCCCCAGGCGACAACACGGGGCGCCCCGTGC

ValGlyIlePheArgAlaAlaValCysThrArgGlyValAlaLysAlaValAspPheIle
1381   CCGTGGGCATATTTAGGGCCGCGGTGTGCACCCGTGGAGTGGCTAAGGCGGTGGACTTTA
       GGCACCCGTATAAATCCCGGCGCCACACGTGGGCACCTCACCGATTCCGCCACCTGAAAT

ProValGluAsnLeuGluThrThrMetArgSerProValPheThrAspAsnSerSerPro
1441   TCCCTGTGGAGAACCTAGAGACAACCATGAGGTCCCCGGTGTTCACGGATAACTCCTCTC
       AGGGACACCTCTTGGATCTCTGTTGGTACTCCAGGGGCCACAAGTGCCTATTGAGGAGAG

ProValValProGlnSerPheGlnValAlaHisLeuHisAlaProThrGlySerGlyLys
1501   CACCAGTAGTGCCCCAGAGCTTCCAGGTGGCTCACCTCCATGCTCCCACAGGCAGCGGCA
       GTGGTCATCACGGGGTCTCGAAGGTCCACCGAGTGGAGGTACGAGGGTGTCCGTCGCCGT

SerThrLysValProAlaAlaTyrAlaAlaGlnGlyTyrLysValLeuValLeuAsnPro
1561   AAAGCACCAAGGTCCCGGCTGCATATGCAGCTCAGGGCTATAAGGTGCTAGTACTCAACC
       TTTCGTGGTTCCAGGGCCGACGTATACGTCGAGTCCCGATATTCCACGATCATGAGTTGG

SerValAlaAlaThrLeuGlyPheGlyAlaTyrMetSerLysAlaHisGlyIleAspPro
1621   CCTCTGTTGCTGCAACACTGGGCTTTGGTGCTTACATGTCCAAGGCTCATGGGATCGATC
       GGAGACAACGACGTTGTGACCCGAAACCACGAATGTACAGGTTCCGAGTACCCTAGCTAG

AsnIleArgThrGlyValArgThrIleThrThrGlySerProIleThrTyrSerThrTyr
1681   CTAACATCAGGACCGGGGTGAGAACAATTACCACTGGCAGCCCCATCACGTACTCCACCT
       GATTGTAGTCCTGGCCCCACTCTTGTTAATGGTGACCGTCGGGGTAGTGCATGAGGTGGA

GlyLysPheLeuAlaAspGlyGlyCysSerGlyGlyAlaTyrAspIleIleIleCysAsp
1741   ACGGCAAGTTCCTTGCCGACGGCGGGTGCTCGGGGGGCGCTTATGACATAATAATTTGTG
       TGCCGTTCAAGGAACGGCTGCCGCCCACGAGCCCCCCGCGAATACTGTATTATTAAACAC

GluCysHisSerThrAspAlaThrSerIleLeuGlyIleGlyThrValLeuAspGlnAla
1801   ACGAGTGCCACTCCACGGATGCCACATCCATCTTGGGCATCGGCACTGTCCTTGACCAAG
       TGCTCACGGTGAGGTGCCTACGGTGTAGGTAGAACCCGTAGCCGTGACAGGAACTGGTTC

GluThrAlaGlyAlaArgLeuValValLeuAlaThrAlaThrProProGlySerValThr
1861   CAGAGACTGCGGGGGCGAGACTGGTTGTGCTCGCCACCGCCACCCCTCCGGGCTCCGTCA
       GTCTCTGACGCCCCCGCTCTGACCAACACGAGCGGTGGCGGTGGGGAGGCCCGAGGCAGT

ValProHisProAsnIleGluGluValAlaLeuSerThrThrGlyGluIleProPheTyr
1921   CTGTGCCCCATCCCAACATCGAGGAGGTTGCTCTGTCCACCACCGGAGAGATCCCTTTTT
       GACACGGGGTAGGGTTGTAGCTCCTCCAACGAGACAGGTGGTGGCCTCTCTAGGGAAAAA
```

FIG. 26C

```
         GlyLysAlaIleProLeuGluValIleLysGlyGlyArgHisLeuIlePheCysHisSer
1981 ACGGCAAGGCTATCCCCCTCGAAGTAATCAAGGGGGGAGACATCTCATCTTCTGTCATT
     TGCCGTTCCGATAGGGGGAGCTTCATTAGTTCCCCCCCTCTGTAGAGTAGAAGACAGTAA

LysLysLysCysAspGluLeuAlaAlaLysLeuValAlaLeuGlyIleAsnAlaValAla
2041 CAAAGAAGAAGTGCGACGAACTCGCCGCAAAGCTGGTCGCATTGGGCATCAATGCCGTGG
     GTTTCTTCTTCACGCTGCTTGAGCGGCGTTTCGACCAGCGTAACCCGTAGTTACGGCACC

TyrTyrArgGlyLeuAspValSerValIleProThrSerGlyAspValValValValAla
2101 CCTACTACCGCGGTCTTGACGTGTCCGTCATCCCGACCAGCGGCGATGTTGTCGTCGTGG
     GGATGATGGCGCCAGAACTGCACAGGCAGTAGGGCTGGTCGCCGCTACAACAGCAGCACC

ThrAspAlaLeuMetThrGlyTyrThrGlyAspPheAspSerValIleAspCysAsnThr
2161 CAACCGATGCCCTCATGACCGGCTATACCGGCGACTTCGACTCGGTGATAGACTGCAATA
     GTTGGCTACGGGAGTACTGGCCGATATGGCCGCTGAAGCTGAGCCACTATCTGACGTTAT

CysValThrGlnThrValAspPheSerLeuAspProThrPheThrIleGluThrIleThr
2221 CGTGTGTCACCCAGACAGTCGATTTCAGCCTTGACCCTACCTTCACCATTGAGACAATCA
     GCACACAGTGGGTCTGTCAGCTAAAGTCGGAACTGGGATGGAAGTGGTAACTCTGTTAGT

LeuProGlnAspAlaValSerArgThrGlnArgArgGlyArgThrGlyArgGlyLysPro
2281 CGCTCCCCCAGGATGCTGTCTCCCGCACTCAACGTCGGGGCAGGACTGGCAGGGGGAAGC
     GCGAGGGGGTCCTACGACAGAGGGCGTGAGTTGCAGCCCCGTCCTGACCGTCCCCCTTCG

GlyIleTyrArgPheValAlaProGlyGluArgProSerGlyMetPheAspSerSerVal
2341 CAGGCATCTACAGATTTGTGGCACCGGGGGAGCGCCCCTCCGGCATGTTCGACTCGTCCG
     GTCCGTAGATGTCTAAACACCGTGGCCCCCTCGCGGGGAGGCCGTACAAGCTGAGCAGGC

LeuCysGluCysTyrAspAlaGlyCysAlaTrpTyrGluLeuThrProAlaGluThrThr
2401 TCCTCTGTGAGTGCTATGACGCAGGCTGTGCTTGGTATGAGCTCACGCCCGCCGAGACTA
     AGGAGACACTCACGATACTGCGTCCGACACGAACCATACTCGAGTGCGGGCGGCTCTGAT

ValArgLeuArgAlaTyrMetAsnThrProGlyLeuProValCysGlnAspHisLeuGlu
2461 CAGTTAGGCTACGAGCGTACATGAACACCCCGGGGCTTCCCGTGTGCCAGGACCATCTTG
     GTCAATCCGATGCTCGCATGTACTTGTGGGGCCCCGAAGGGCACACGGTCCTGGTAGAAC

PheTrpGluGlyValPheThrGlyLeuThrHisIleAspAlaHisPheLeuSerGlnThr
2521 AATTTTGGGAGGGCGTCTTTACAGGCCTCACTCATATAGATGCCCACTTTCTATCCCAGA
     TTAAAACCCTCCCGCAGAAATGTCCGGAGTGAGTATATCTACGGGTGAAAGATAGGGTCT

LysGlnSerGlyGluAsnLeuProTyrLeuValAlaTyrGlnAlaThrValCysAlaArg
2581 CAAAGCAGAGTGGGGAGAACCTTCCTTACCTGGTAGCGTACCAAGCCACCGTGTGCGCTA
     GTTTCGTCTCACCCCTCTTGGAAGGAATGGACCATCGCATGGTTCGGTGGCACACGCGAT

AlaGlnAlaProProProSerTrpAspGlnMetTrpLysCysLeuIleArgLeuLysPro
2641 GGGCTCAAGCCCCTCCCCCATCGTGGGACCAGATGTGGAAGTGTTTGATTCGCCTCAAGC
     CCCGAGTTCGGGGAGGGGGTAGCACCCTGGTCTACACCTTCACAAACTAAGCGGAGTTCG

ThrLeuHisGlyProThrProLeuLeuTyrArgLeuGlyAlaValGlnAsnGluIleThr
2701 CCACCCTCCATGGGCCAACACCCCTGCTATACAGACTGGGCGCTGTTCAGAATGAAATCA
     GGTGGGAGGTACCCGGTTGTGGGGACGATATGTCTGACCCGCGACAAGTCTTACTTTAGT

LeuThrHisProValThrLysTyrIleMetThrCysMetSerAlaAspLeuGluValVal
2761 CCCTGACGCACCCAGTCACCAAATACATCATGACATGCATGTCGGCCGACCTGGAGGTCG
     GGGACTGCGTGGGTCAGTGGTTTATGTAGTACTGTACGTACAGCCGGCTGGACCTCCAGC

ThrSerThrTrpValLeuValGlyGlyValLeuAlaAlaLeuAlaAlaTyrCysLeuSer
2821 TCACGAGCACCTGGGTGCTCGTTGGCGGCGTCCTGGCTGCTTTGGCCGCGTATTGCCTGT
     AGTGCTCGTGGACCCACGAGCAACCGCCGCAGGACCGACGAAACCGGCGCATAACGGACA

ThrGlyCysValValIleValGlyArgValValLeuSerGlyLysProAlaIleIlePro
2881 CAACAGGCTGCGTGGTCATAGTGGGCAGGGTCGTCTTGTCCGGGAAGCCGGCAATCATAC
     GTTGTCCGACGCACCAGTATCACCCGTCCCAGCAGAACAGGCCCTTCGGCCGTTAGTATG

AspArgGluValLeuTyrArgGluPheAspGluMetGluGluCysSerGlnHisLeuPro
2941 CTGACAGGGAAGTCCTCTACCGAGAGTTCGATGAGATGGAAGAGTGCTCTCAGCACTTAC
     GACTGTCCCTTCAGGAGATGGCTCTCAAGCTACTCTACCTTCTCACGAGAGTCGTGAATG
```

FIG. 26D

```
              TyrIleGluGlnGlyMetMetLeuAlaGluGlnPheLysGlnLysAlaLeuGlyLeuLeu
3001 CGTACATCGAGCAAGGGATGATGCTCGCCGAGCAGTTCAAGCAGAAGGCCCTCGGCCTCC
     GCATGTAGCTCGTTCCCTACTACGAGCGGCTCGTCAAGTTCGTCTTCCGGGAGCCGGAGG

GlnThrAlaSerArgGlnAlaGluValIleAlaProAlaValGlnThrAsnTrpGlnLys
3061 TGCAGACCGCGTCCCGTCAGGCAGAGGTTATCGCCCCTGCTGTCCAGACCAACTGGCAAA
     ACGTCTGGCGCAGGGCAGTCCGTCTCCAATAGCGGGGACGACAGGTCTGGTTGACCGTTT

LeuGluThrPheTrpAlaLysHisMetTrpAsnPheIleSerGlyIleGlnTyrLeuAla
3121 AACTCGAGACCTTCTGGGCGAAGCATATGTGGAACTTCATCAGTGGGATACAATACTTGG
     TTGAGCTCTGGAAGACCCGCTTCGTATACACCTTGAAGTAGTCACCCTATGTTATGAACC

GlyLeuSerThrLeuProGlyAsnProAlaIleAlaSerLeuMetAlaPheThrAlaAla
3181 CGGGCTTGTCAACGCTGCCTGGTAACCCCGCCATTGCTTCATTGATGGCTTTTACAGCTG
     GCCCGAACAGTTGCGACGGACCATTGGGGCGGTAACGAAGTAACTACCGAAAATGTCGAC

ValThrSerProLeuThrThrSerGlnThrLeuLeuPheAsnIleLeuGlyGlyTrpVal
3241 CTGTCACCAGCCCACTAACCACTAGCCAAACCCTCCTCTTCAACATATTGGGGGGGTGGG
     GACAGTGGTCGGGTGATTGGTGATCGGTTTGGGAGGAGAAGTTGTATAACCCCCCCACCC

AlaAlaGlnLeuAlaAlaProGlyAlaAlaThrAlaPheValGlyAlaGlyLeuAlaGly
3301 TGGCTGCCCAGCTCGCCGCCCCGGTGCCGCTACTGCCTTTGTGGGCGCTGGCTTAGCTG
     ACCGACGGGTCGAGCGGCGGGGGCCACGGCGATGACGGAAACACCCGCGACCGAATCGAC

AlaAlaIleGlySerValGlyLeuGlyLysValLeuIleAspIleLeuAlaGlyTyrGly
3361 GCGCCGCCATCGGCAGTGTTGGACTGGGGAAGGTCCTCATAGACATCCTTGCAGGGTATG
     CGCGGCGGTAGCCGTCACAACCTGACCCCTTCCAGGAGTATCTGTAGGAACGTCCCATAC

AlaGlyValAlaGlyAlaLeuValAlaPheLysIleMetSerGlyGluValProSerThr
3421 GCGCGGGCGTGGCGGGAGCTCTTGTGGCATTCAAGATCATGAGCGGTGAGGTCCCCTCCA
     CGCGCCCGCACCGCCCTCGAGAACACCGTAAGTTCTAGTACTCGCCACTCCAGGGGAGGT

GluAspLeuValAsnLeuLeuProAlaIleLeuSerProGlyAlaLeuValValGlyVal
3481 CGGAGGACCTGGTCAATCTACTGCCCGCCATCCTCTCGCCCGGAGCCCTCGTAGTCGGCG
     GCCTCCTGGACCAGTTAGATGACGGGCGGTAGGAGAGCGGGCCTCGGGAGCATCAGCCGC

ValCysAlaAlaIleLeuArgArgHisValGlyProGlyGluGlyAlaValGlnTrpMet
3541 TGGTCTGTGCAGCAATACTGCGCCGGCACGTTGGCCCGGGCGAGGGGGCAGTGCAGTGGA
     ACCAGACACGTCGTTATGACGCGGCCGTGCAACCGGGCCCGCTCCCCCGTCACGTCACCT

AsnArgLeuIleAlaPheAlaSerArgGlyAsnHisValSerProThrHisTyrValPro
3601 TGAACCGGCTGATAGCCTTCGCCTCCCGGGGGAACCATGTTTCCCCCACGCACTACGTGC
     ACTTGGCCGACTATCGGAAGCGGAGGGCCCCCTTGGTACAAAGGGGGTGCGTGATGCACG

GluSerAspAlaAlaAlaArgValThrAlaIleLeuSerSerLeuThrValThrGlnLeu
3661 CGGAGAGCGATGCAGCTGCCCGCGTCACTGCCATACTCAGCAGCCTCACTGTAACCCAGC
     GCCTCTCGCTACGTCGACGGGCGCAGTGACGGTATGAGTCGTCGGAGTGACATTGGGTCG

LeuArgArgLeuHisGlnTrpIleSerSerGluCysThrThrProCysSerGlySerTrp
3721 TCCTGAGGCGACTGCACCAGTGGATAAGCTCGGAGTGTACCACTCCATGCTCCGGTTCCT
     AGGACTCCGCTGACGTGGTCACCTATTCGAGCCTCACATGGTGAGGTACGAGGCCAAGGA

LeuArgAspIleTrpAspTrpIleCysGluValLeuSerAspPheLysThrTrpLeuLys
3781 GGCTAAGGGACATCTGGGACTGGATATGCGAGGTGTTGAGCGACTTTAAGACCTGGCTAA
     CCGATTCCCTGTAGACCCTGACCTATACGCTCCACAACTCGCTGAAATTCTGGACCGATT

AlaLysLeuMetProGlnLeuProGlyIleProPheValSerCysGlnArgGlyTyrLys
3841 AAGCTAAGCTCATGCCACAGCTGCCTGGGATCCCCTTTGTGTCCTGCCAGCGCGGGTATA
     TTCGATTCGAGTACGGTGTCGACGGACCCTAGGGGAAACACAGGACGGTCGCGCCCATAT

GlyValTrpArgValAspGlyIleMetHisThrArgCysHisCysGlyAlaGluIleThr
3901 AGGGGGTCTGGCGAGTGGACGGCATCATGCACACTCGCTGCCACTGTGGAGCTGAGATCA
     TCCCCCAGACCGCTCACCTGCCGTAGTACGTGTGAGCGACGGTGACACCTCGACTCTAGT

GlyHisValLysAsnGlyThrMetArgIleValGlyProArgThrCysArgAsnMetTrp
3961 CTGGACATGTCAAAAACGGGACGATGAGGATCGTCGGTCCTAGGACCTGCAGGAACATGT
     GACCTGTACAGTTTTTGCCCTGCTACTCCTAGCAGCCAGGATCCTGGACGTCCTTGTACA
```

FIG. 26E

```
           SerGlyThrPheProIleAsnAlaTyrThrThrGlyProCysThrProLeuProAlaPro
4021 GGAGTGGGACCTTCCCCATTAATGCCTACACCACGGGCCCCTGTACCCCCCTTCCTGCGC
     CCTCACCCTGGAAGGGGTAATTACGGATGTGGTGCCCGGGGACATGGGGGGAAGGACGCG

AsnTyrThrPheAlaLeuTrpArgValSerAlaGluGluTyrValGluIleArgGlnVal
4081 CGAACTACACGTTCGCGCTATGGAGGGTGTCTGCAGAGGAATATGTGGAGATAAGGCAGG
     GCTTGATGTGCAAGCGCGATACCTCCCACAGACGTCTCCTTATACACCTCTATTCCGTCC

GlyAspPheHisTyrValThrGlyMetThrThrAspAsnLeuLysCysProCysGlnVal
4141 TGGGGACTTCCACTACGTGACGGGTATGACTACTGACAATCTCAAATGCCCGTGCCAGG
     ACCCCCTGAAGGTGATGCACTGCCCATACTGATGACTGTTAGAGTTTACGGGCACGGTCC

ProSerProGluPhePheThrGluLeuAspGlyValArgLeuHisArgPheAlaProPro
4201 TCCCATCGCCCGAATTTTTCACAGAATTGGACGGGGTGCGCCTACATAGGTTTGCGCCCC
     AGGGTAGCGGGCTTAAAAAGTGTCTTAACCTGCCCCACGCGGATGTATCCAAACGCGGGG

CysLysProLeuLeuArgGluGluValSerPheArgValGlyLeuHisGluTyrProVal
4261 CCTGCAAGCCCTTGCTGCGGGAGGAGGTATCATTCAGAGTAGGACTCCACGAATACCCGG
     GGACGTTCGGGAACGACGCCCTCCTCCATAGTAAGTCTCATCCTGAGGTGCTTATGGGCC

GlySerGlnLeuProCysGluProGluProAspValAlaValLeuThrSerMetLeuThr
4321 TAGGGTCGCAATTACCTTGCGAGCCCGAACCGGACGTGGCCGTGTTGACGTCCATGCTCA
     ATCCCAGCGTTAATGGAACGCTCGGGCTTGGCCTGCACCGGCACAACTGCAGGTACGAGT

AspProSerHisIleThrAlaGluAlaAlaGlyArgArgLeuAlaArgGlySerProPro
4381 CTGATCCCTCCCATATAACAGCAGAGGCGGCCGGGCGAAGGTTGGCGAGGGGATCACCCC
     GACTAGGGAGGGTATATTGTCGTCTCCGCCGGCCCGCTTCCAACCGCTCCCCTAGTGGGG

SerValAlaSerSerSerAlaSerGlnLeuSerAlaProSerLeuLysAlaThrCysThr
4441 CCTCTGTGGCCAGCTCCTCGGCTAGCCAGCTATCCGCTCCATCTCTCAAGGCAACTTGCA
     GGAGACACCGGTCGAGGAGCCGATCGGTCGATAGGCGAGGTAGAGAGTTCCGTTGAACGT

AlaAsnHisAspSerProAspAlaGluLeuIleGluAlaAsnLeuLeuTrpArgGlnGlu
4501 CCGCTAACCATGACTCCCCTGATGCTGAGCTCATAGAGGCCAACCTCCTATGGAGGCAGG
     GGCGATTGGTACTGAGGGGACTACGACTCGAGTATCTCCGGTTGGAGGATACCTCCGTCC

MetGlyGlyAsnIleThrArgValGluSerGluAsnLysValValIleLeuAspSerPhe
4561 AGATGGGCGGCAACATCACCAGGGTTGAGTCAGAAAACAAAGTGGTGATTCTGGACTCCT
     TCTACCCGCCGTTGTAGTGGTCCCAACTCAGTCTTTTGTTTCACCACTAAGACCTGAGGA

AspProLeuValAlaGluGluAspGluArgGluIleSerValProAlaGluIleLeuArg
4621 TCGATCCGCTTGTGGCGGAGGAGGACGAGCGGGAGATCTCCGTACCCGCAGAAATCCTGC
     AGCTAGGCGAACACCGCCTCCTCCTGCTCGCCCTCTAGAGGCATGGGCGTCTTTAGGACG

LysSerArgArgPheAlaGlnAlaLeuProValTrpAlaArgProAspTyrAsnProPro
4681 GGAAGTCTCGGAGATTCGCCCAGGCCCTGCCCGTTTGGGCGCGGCCGGACTATAACCCCC
     CCTTCAGAGCCTCTAAGCGGGTCCGGGACGGGCAAACCCGCGCCGGCCTGATATTGGGGG

LeuValGluThrTrpLysLysProAspTyrGluProProValValHisGlyCysProLeu
4741 CGCTAGTGGAGACGTGGAAAAAGCCCGACTACGAACCACCTGTGGTCCATGGCTGTCCGC
     GCGATCACCTCTGCACCTTTTTCGGGCTGATGCTTGGTGGACACCAGGTACCGACAGGCG

ProProProLysSerProProValProProProArgLysLysArgThrValValLeuThr
4801 TTCCACCTCCAAAGTCCCCTCCTGTGCCTCCGCCTCGGAAGAAGCGGACGGTGGTCCTCA
     AAGGTGGAGGTTTCAGGGGAGGACACGGAGGCGGAGCCTTCTTCGCCTGCCACCAGGAGT

GluSerThrLeuSerThrAlaLeuAlaGluLeuAlaThrArgSerPheGlySerSerSer
4861 CTGAATCAACCCTATCTACTGCCTTGGCCGAGCTCGCCACCAGAAGCTTTGGCAGCTCCT
     GACTTAGTTGGGATAGATGACGGAACCGGCTCGAGCGGTGGTCTTCGAAACCGTCGAGGA

ThrSerGlyIleThrGlyAspAsnThrThrThrSerSerGluProAlaProSerGlyCys
4921 CAACTTCCGGCATTACGGGCGACAATACGACAACATCCTCTGAGCCCGCCCCTTCTGGCT
     GTTGAAGGCCGTAATGCCCGCTGTTATGCTGTTGTAGGAGACTCGGGCGGGGAAGACCGA

ProProAspSerAspAlaGluSerTyrSerSerMetProProLeuGluGlyGluProGly
4981 GCCCCCCGACTCCGACGCTGAGTCCTATTCCTCCATGCCCCCCCTGGAGGGGGAGCCTG
     CGGGGGGGCTGAGGCTGCGACTCAGGATAAGGAGGTACGGGGGGGACCTCCCCCTCGGAC
```

FIG. 26F

```
             AspProAspLeuSerAspGlySerTrpSerThrValSerSerGluAlaAsnAlaGluAsp
5041 GGGATCCGGATCTTAGCGACGGGTCATGGTCAACGGTCAGTAGTGAGGCCAACGCGGAGG
     CCCTAGGCCTAGAATCGCTGCCCAGTACCAGTTGCCAGTCATCACTCCGGTTGCGCCTCC

ValValCysCysSerMetSerTyrSerTrpThrGlyAlaLeuValThrProCysAlaAla
5101 ATGTCGTGTGCTGCTCAATGTCTTACTCTTGGACAGGCGCACTCGTCACCCCGTGCGCCG
     TACAGCACACGACGAGTTACAGAATGAGAACCTGTCCGCGTGAGCAGTGGGGCACGCGGC

GluGluGlnLysLeuProIleAsnAlaLeuSerAsnSerLeuLeuArgHisHisAsnLeu
5161 CGGAAGAACAGAAACTGCCCATCAATGCACTAAGCAACTCGTTGCTACGTCACCACAATT
     GCCTTCTTGTCTTTGACGGGTAGTTACGTGATTCGTTGAGCAACGATGCAGTGGTGTTAA

ValTyrSerThrThrSerArgSerAlaCysGlnArgGlnLysLysValThrPheAspArg
5221 TGGTGTATTCCACCACCTCACGCAGTGCTTGCCAAAGGCAGAAGAAAGTCACATTTGACA
     ACCACATAAGGTGGTGGAGTGCGTCACGAACGGTTTCCGTCTTCTTTCAGTGTAAACTGT

LeuGlnValLeuAspSerHisTyrGlnAspValLeuLysGluValLysAlaAlaAlaSer
5281 GACTGCAAGTTCTGGACAGCCATTACCAGGACGTACTCAAGGAGGTTAAAGCAGCGGCGT
     CTGACGTTCAAGACCTGTCGGTAATGGTCCTGCATGAGTTCCTCCAATTTCGTCGCCGCA

LysValLysAlaAsnLeu
5341 CAAAAGTGAAGGCTAACTTG
     GTTTTCACTTCCGATTGAAC
```

FIG. 30

```
     -------------------------------------------------------------
             GlyGlyGluAsnCysGlyTyrArgArgCysArgAlaSerGlyValLeuThrThrSerCys
   1 GGGGGGGAGAACTGCGGCTATCGCAGGTGCCGCGCAAGCGGCGTACTGACAACTAGCTGT
     CCCCCCCTCTTGACGCCGATAGCGTCCACGGCGCGTTCGCCGCATGACTGTTGATCGACA

GlyAsnThrLeuThrCysTyrIleLysAlaArgAlaAlaCysArgAlaAlaGlyLeuGln
  61 GGTAACACCCTCACTTGTTACATCAAGGCCCGAGCAGCCTGTCGAGCCGCAGGGCTCCAG
     CCATTGTGGGAGTGAACAATGTAGTTCCGGGCTCGTCGGACAGCTCGGCGTCCCGAGGTC

-------------Overlap with 19g--------------------------------
             AspCysThrMetLeuValCysGlyAspAspLeuValValIleCysGluSerAlaGlyVal
 121 GACTGCACCATGCTCGTGTGTGGCGACGACTTAGTCGTTATCTGTGAAAGCGCGGGGGTC
     CTGACGTGGTACGAGCACACACCGCTGCTGAATCAGCAATAGACACTTTCGCGCCCCCAG
     ----------------
             GlnGluAspAlaAlaSerLeuArgAlaPheThrGluAlaMetThrArgTyrSerAlaPro
 181 CAGGAGGACGCGGCGAGCCTGAGAGCCTTCACGGAGGCTATGACCAGGTACTCCGCCCCC
     GTCCTCCTGCGCCGCTCGGACTCTCGGAAGTGCCTCCGATACTGGTCCATGAGGCGGGGG ProGlyAspProProGlnProGluTyrAspLeuGluLeuIleThrSerCysSerSerAsn
 241 CCTGGGGACCCCCCACAACCAGAATACGACTTGGAGCTCATAACATCATGCTCCTCCAAC
     GGACCCCTGGGGGGTGTTGGTCTTATGCTGAACCTCGAGTATTGTAGTACGAGGAGGTTG ValSerValAlaHisAspGlyAlaGlyLysArgValTyrTyrLeuThrArgAspProThr
 301 GTGTCAGTCGCCCACGACGGCGCTGGAAAGAGGGTCTACTACCTCACCCGTGACCCTACA
     CACAGTCAGCGGGTGCTGCCGCGACCTTTCTCCCAGATGATGGAGTGGGCACTGGGATGT ThrProLeuAlaArgAlaAlaTrpGluThrAlaArgHisThrProValAsnSerTrpLeu
 361 ACCCCCCTCGCGAGAGCTGCGTGGGAGACAGCAAGACACACTCCAGTCAATTCCTGGCTA
     TGGGGGGAGCGCTCTCGACGCACCCTCTGTCGTTCTGTGTGAGGTCAGTTAAGGACCGAT GlyAsnIleIleMetPheAlaProThrLeuTrpAla
 421 GGCAACATAATCATGTTTGCCCCCACACTGTGGGCG
     CCGTTGTATTAGTACAAACGGGGGTGTGACACCCGC
```

FIG. 27

```
    IlePheLysIleArgMetTyrValGlyGlyValGluHisArgLeuGluAlaAlaCysAsn
  1 CCATATTAAAATCAGGATGTACGTGGGAGGGGTCGAACACAGGCTGGAAGCTGCCTGCA
    GGTATAATTTTAGTCCTACATGCACCCTCCCCAGCTTGTGTCCGACCTTCGACGACGT

TrpThrArgGlyGluArgCysAspLeuGluGluArgArgAspArgSerGluLeuSerProLeu
 61 ACTGGACGCGGGGCCGAACGTTGCGATCTGGAAGACAGGACAGGTCCGAGCTCAGCCGT
    TGACCTGCGCCCCGGCTTGCAACGCTAGACCTTCTGTCCTGTCCAGGCTCGAGTCGGCA

LeuLeuThrThrThrGlnTrpGlnValLeuProCysSerPheThrThrLeuProAlaLeu
121 TACTGCTGACCACTACACAGTGGCAGGTCCCTCCCGTGTCCTTCACAACCCTACCAGCCT
    ATGACGACTGGTGATGTGTCACCGTCCAGGAGGGCACAAGGAAGTGTTGGGATGGTCGGA

SerThrGlyLeuIleHisLeuHisGlnAsnIleValAspValGlnTyrLeuTyrGlyVal
181 TGTCCACCGGCCTCATCCACCTCCACCAGAACATTGTGGACGTGCAGTACTTGTACGGG
    ACAGGTGGCCGGAGTAGGTGGAGGTGGTCTTGTAACACCTGCACGTCATGAACATGCCC

GlySerSerIleAlaSerTrpAlaAlaIleLysTrpGluTyrValValLeuLeuPheLeuLeu
241 TGGGGTCAAGCATCGCGTCCTGGGCCATTAAGTGGGAGTACGTCGTTCTCCTGTTCCTTC
    ACCCCAGTTCGTAGCGCAGGACCCGGTAATTCACCCTCATGCAGCAAGAGGACAAGGAAG

LeuAlaAspAlaArgValCysSerCysLeuTrpMetMetLeuLeuIleSerGlnAlaGlu
301 TGCTTGCAGACGCGCCGCGTCTGCTCCTGTTGATGATGCTACTCATATCCCAAGCGG
    ACGAACGTCTGCGCGCAGACGAGGACGAACACCTACTACGATGAGTATAGGGTTCGCC

AlaAlaLeuGluAsnLeuValIleLeuAsnAlaAlaSerLeuAlaGlyThrHisGlyLeu
361 AGGCGGCTTTGGAGAACCTCGTAATACTTAATGCAGCATCCCTGGCCGGACGACGGTC
    TCCGCCGAAACCTCTTGGAGCATTATGAATTACGTCGTAGGGACCGGCCCTGCCAG

Val
421 TTGTATC
    AACATAG
```

FIG. 28

```
             ----------Overlap with 39c--------------------
           LeuLysGluValLysAlaAlaAlaSerLysValLysAlaAsnLeuLeuSerValGluGlu
   1   TGCTCAAGGAGGTTAAAGCAGCGGCGTCAAAAGTGAAGGCTAACTTGCTATCCGTAGAGG
       ACGAGTTCCTCCAATTTCGTCGCCGCAGTTTTCACTTCCGATTGAACGATAGGCATCTCC AlaCysSerLeuThrProProHisSerAlaLysSerLysPheGlyTyrGlyAlaLysAsp
  61   AAGCTTGCAGCCTGACGCCCCCACACTCAGCCAAATCCAAGTTTGGTTATGGGGCAAAAG
       TTCGAACGTCGGACTGCGGGGGTGTGAGTCGGTTTAGGTTCAAACCAATACCCCGTTTTC ValArgCysHisAlaArgLysAlaValThrHisIleAsnSerValTrpLysAspLeuLeu
 121   ACGTCCGTTGCCATGCCAGAAAGGCCGTAACCCACATCAACTCCGTGTGGAAAGACCTTC
       TGCAGGCAACGGTACGGTCTTTCCGGCATTGGGTGTAGTTGAGGCACACCTTTCTGGAAG GluAspAsnValThrProIleAspThrThrIleMetAlaLysAsnGluValPheCysVal
 181   TGGAAGACAATGTAACACCAATAGACACTACCATCATGGCTAAGAACGAGGTTTTCTGCG
       ACCTTCTGTTACATTGTGGTTATCTGTGATGGTAGTACCGATTCTTGCTCCAAAAGACGC GlnProGluLysGlyGlyArgLysProAlaArgLeuIleValPheProAspLeuGlyVal
 241   TTCAGCCTGAGAAGGGGGGTCGTAAGCCAGCTCGTCTCATCGTGTTCCCCGATCTGGGCG
       AAGTCGGACTCTTCCCCCCAGCATTCGGTCGAGCAGAGTAGCACAAGGGGCTAGACCCGC ArgValCysGluLysMetAlaLeuTyrAspValValThrLysLeuProLeuAlaValMet
 301   TGCGCGTGTGCGAAAAGATGGCTTTGTACGACGTGGTTACAAAGCTCCCCTTGGCCGTGA
       ACGCGCACACGCTTTTCTACCGAAACATGCTGCACCAATGTTTCGAGGGGAACCGGCACT GlySerSerTyrGlyPheGlnTyrSerProGlyGlnArgValGluPheLeuValGlnAla
 361   TGGGAAGCTCCTACGGATTCCAATACTCACCAGGACAGCGGGTTGAATTCCTCGTGCAAG
       ACCCTTCGAGGATGCCTAAGGTTATGAGTGGTCCTGTCGCCCAACTTAAGGAGCACGTTC TrpLysSerLysLysThrProMetGlyPheSerTyrAspThrArgCysPheAspSerThr
 421   CGTGGAAGTCCAAGAAAACCCCAATGGGGTTCTCGTATGATACCCGCTGCTTTGACTCCA
       GCACCTTCAGGTTCTTTTGGGGTTACCCCAAGAGCATACTATGGGCGACGAAACTGAGGT ValThrGluSerAspIleArgThrGluGluAla
 481   CAGTCACTGAGAGCGACATCCGTACGGAGGAGGCA
       GTCAGTGACTCTCGCTGTAGGCATGCCTCCTCCGT
```

FIG. 29

```
         GluPheLeuValGlnAlaTrpLysSerLysLysThrProMetGlyPheSerTyrAspThr
    1    GAATTCCTCGTGCAAGCGTGGAAGTCCAAGAAAACCCCAATGGGGTTCTCGTATGATACC
         CTTAAGGAGCACGTTCGCACCTTCAGGTTCTTTTGGGGTTACCCCAAGAGCATACTATGC

-------------Overlap with 35f-------------------
         ArgCysPheAspSerThrValThrGluSerAspIleArgThrGluGluAlaIleTyrGln
   61    CGCTGCTTTGACTCCACAGTCACTGAGAGCGACATCCGTACGGAGGAGGCAATCTACCAA
         GCGACGAAACTGAGGTGTCAGTGACTCTCGCTGTAGGCATGCCTCCTCCGTTAGATGGTT CysCysAspLeuAspProGlnAlaArgValAlaIleLysSerLeuThrGluArgLeuTyr
  121    TGTTGTGACCTCGACCCCCAAGCCCGCGTGGCCATCAAGTCCCTCACCGAGAGGCTTTAT
         ACAACACTGGAGCTGGGGGTTCGGGCGCACCGGTAGTTCAGGGAGTGGCTCTCCGAAATA ValGlyGlyProLeuThrAsnSerArgGlyGluAsnCysGlyTyrArgArgCysArgAla
  181    GTTGGGGGCCCTCTTACCAATTCAAGGGGGGAGAACTGCGGCTATCGCAGGTGCCGCGCG
         CAACCCCCGGGAGAATGGTTAAGTTCCCCCCTCTTGACGCCGATAGCGTCCACGGCGCGC SerGlyValLeuThrThrSerCysGlyAsnThrLeuThrCysTyrIleLysAlaArgAla
  241    AGCGGCGTACTGACAACTAGCTGTGGTAACACCCTCACTTGCTACATCAAGGCCCGGGCA
         TCGCCGCATGACTGTTGATCGACACCATTGTGGGAGTGAACGATGTAGTTCCGGGCCCGT AlaCysArgAlaAlaGlyLeuGlnAspCysThrMetLeuValCysGlyAspAspLeuVal
  301    GCCTGTCGAGCCGCAGGGCTCCAGGACTGCACCATGCTCGTGTGTGGCGACGACTTAGTC
         CGGACAGCTCGGCGTCCCGAGGTCCTGACGTGGTACGAGCACACACCGCTGCTGAATCAG ValIleCysGluSerAlaGlyValGlnGluAspAlaAla
  361    GTTATCTGTGAAAGCGCGGGGGTCCAGGAGGACGCGGCGAG
         CAATAGACACTTTCGCGCCCCCAGGTCCTCCTGCGCCGCTC
```

FIG. 31

```
                                         GlyAlaGlyLysArgValTyrTyrLeuThrArgAspProThrThrProLeuAlaArgAla
  1   CGGCGCTGGAAAGAGGGTCTACTACCTCACCCGTGACCCTACAACCCCTCGCGAGAGC
      GCCGCGACCTTTCTCCCAGATGATGGAGTGGGCACTGGGATGTTGGGGGAGCGCTCTCG

-------Overlap with 26g-------
                                         AlaTrpGluThrAlaArgHisThrProValAsnSerTrpLeuGlyAsnIleIleMetPhe
 61   TGCGTGGGAGACAGCAAGACACACTCCAGTCAATTCCTGGCTAGGCAACATAATCATGTT
      ACGCACCCTCTGTCGTTCTGTGTGAGGTCAGTTAAGGACCGATCCGTTGTATTAGTACAA AlaProThrLeuTrpAlaArgMetIleLeuMetThrHisPhePheSerValLeuIleAla
121   TGCCCCACACTGTGGGCGGAGGATGATACTGATGACCCATTCTTTAGCGTCCTTATAGC
      ACGGGGTGTGACACCCGCCTCCTACTATGACTACTGGGTAAGAAATCGCAGGAATATCG ArgAspGlnLeuGluGlnAlaLeuAspCysGluIleTyrGlyAlaCysTyrSerIleGlu
181   CAGGGACCAGCTTGAACAGGCCCTCGATTGCGAGATCTACGGGCCTGCTACTCCATAGA
      GTCCCTGGTCGAACTTGTCCGGGAGCTAACGCTCTAGATGCCCGGACGATGAGGTATCT ProLeuAspLeuProProIleIleGlnArgLeu
241   ACCACTTGATCTACCTCCAATCATTCAAAGACTC
      TGGTGAACTAGATGGAGGTTAGTAAGTTTCTGAG
```

FIG. 32A

```
      IlePheLysIleArgMetTyrValGlyGlyValGluHisArgLeuGluAlaAlaCysAsn
  1 CCATATTTAAAATCAGGATGTACGTGGGAGGGGTCGAACACAGGCTGGAAGCTGCCTGCA
    GGTATAAATTTTAGTCCTACATGCACCCTCCCCAGCTTGTGTCCGACCTTCGACGGACGT

TrpThrArgGlyGluArgCysAspLeuGluAspArgAspArgSerGluLeuSerProLeu
 61 ACTGGACGCGGGGCGAACGTTGCGATCTGGAAGACAGGGACAGGTCCGAGCTCAGCCCGT
    TGACCTGCGCCCCGCTTGCAACGCTAGACCTTCTGTCCCTGTCCAGGCTCGAGTCGGGCA

LeuLeuThrThrThrGlnTrpGlnValLeuProCysSerPheThrThrLeuProAlaLeu
121 TACTGCTGACCACTACACAGTGGCAGGTCCTCCCGTGTTCCTTCACAACCCTACCAGCCT
    ATGACGACTGGTGATGTGTCACCGTCCAGGAGGGCACAAGGAAGTGTTGGGATGGTCGGA

SerThrGlyLeuIleHisLeuHisGlnAsnIleValAspValGlnTyrLeuTyrGlyVal
181 TGTCCACCGGCCTCATCCACCTCCACCAGAACATTGTGGACGTGCAGTACTTGTACGGGG
    ACAGGTGGCCGGAGTAGGTGGAGGTGGTCTTGTAACACCTGCACGTCATGAACATGCCCC

GlySerSerIleAlaSerTrpAlaIleLysTrpGluTyrValValLeuLeuPheLeuLeu
241 TGGGGTCAAGCATCGCGTCCTGGGCCATTAAGTGGGAGTACGTCGTTCTCCTGTTCCTTC
    ACCCCAGTTCGTAGCGCAGGACCCGGTAATTCACCCTCATGCAGCAAGAGGACAAGGAAG

LeuAlaAspAlaArgValCysSerCysLeuTrpMetMetLeuLeuIleSerGlnAlaGlu
301 TGCTTGCAGACGCGCGCGTCTGCTCCTGCTTGTGGATGATGCTACTCATATCCCAAGCGG
    ACGAACGTCTGCGCGCGCAGACGAGGACGAACACCTACTACGATGAGTATAGGGTTCGCC

AlaAlaLeuGluAsnLeuValIleLeuAsnAlaAlaSerLeuAlaGlyThrHisGlyLeu
361 AGGCGGCTTTGGAGAACCTCGTAATACTTAATGCAGCATCCCTGGCCGGGACGCACGGTC
    TCCGCCGAAACCTCTTGGAGCATTATGAATTACGTCGTAGGGACCGGCCCTGCGTGCCAG

ValSerPheLeuValPhePheCysPheAlaTrpTyrLeuLysGlyLysTrpValProGly
421 TTGTATCCTTCCTCGTGTTCTTCTGCTTTGCATGGTATTTGAAGGGTAAGTGGGTGCCCG
    AACATAGGAAGGAGCACAAGAAGACGAAACGTACCATAAACTTCCCATTCACCCACGGGC

AlaValTyrThrPheTyrGlyMetTrpProLeuLeuLeuLeuLeuLeuAlaLeuProGln
481 GAGCGGTCTACACCTTCTACGGGATGTGGCCTCTCCTCCTGCTCCTGTTGGCGTTGCCCC
    CTCGCCAGATGTGGAAGATGCCCTACACCGGAGAGGAGGACGAGGACAACCGCAACGGGG

ArgAlaTyrAlaLeuAspThrGluValAlaAlaSerCysGlyGlyValValLeuValGly
541 AGCGGGCGTACGCGCTGGACACGGAGGTGGCCGCGTCGTGTGGCGGTGTTGTTCTCGTCG
    TCGCCCGCATGCGCGACCTGTGCCTCCACCGGCGCAGCACACCGCCACAACAAGAGCAGC

LeuMetAlaLeuThrLeuSerProTyrTyrLysArgTyrIleSerTrpCysLeuTrpTrp
601 GGTTGATGGCGCTGACTCTGTCACCATATTACAAGCGCTATATCAGCTGGTGCTTGTGGT
    CCAACTACCGCGACTGAGACAGTGGTATAATGTTCGCGATATAGTCGACCACGAACACCA

LeuGlnTyrPheLeuThrArgValGluAlaGlnLeuHisValTrpIleProProLeuAsn
661 GGCTTCAGTATTTTCTGACCAGAGTGGAAGCGCAACTGCACGTGTGGATTCCCCCCCTCA
    CCGAAGTCATAAAAGACTGGTCTCACCTTCGCGTTGACGTGCACACCTAAGGGGGGGAGT

ValArgGlyGlyArgAspAlaValIleLeuLeuMetCysAlaValHisProThrLeuVal
721 ACGTCCGAGGGGGGCGCGACGCCGTCATCTTACTCATGTGTGCTGTACACCCGACTCTGG
    TGCAGGCTCCCCCCGCGCTGCGGCAGTAGAATGAGTACACACGACATGTGGGCTGAGACC

PheAspIleThrLysLeuLeuLeuAlaValPheGlyProLeuTrpIleLeuGlnAlaSer
781 TATTTGACATCACCAAATTGCTGCTGGCCGTCTTCGGACCCCTTTGGATTCTTCAAGCCA
    ATAAACTGTAGTGGTTTAACGACGACCGGCAGAAGCCTGGGGAAACCTAAGAAGTTCGGT

LeuLeuLysValProTyrPheValArgValGlnGlyLeuLeuArgPheCysAlaLeuAla
841 GTTTGCTTAAAGTACCCTACTTTGTGCGCGTCCAAGGCCTTCTCCGGTTCTGCGCGTTAG
    CAAACGAATTTCATGGGATGAAACACGCGCAGGTTCCGGAAGAGGCCAAGACGCGCAATC
```

FIG. 32B

```
         ArgLysMetIleGlyGlyHisTyrValGlnMetValIleIleLysLeuGlyAlaLeuThr
 901 CGCGGAAGATGATCGGAGGCCATTACGTGCAAATGGTCATCATTAAGTTAGGGGCGCTTA
     GCGCCTTCTACTAGCCTCCGGTAATGCACGTTTACCAGTAGTAATTCAATCCCCGCGAAT

GlyThrTyrValTyrAsnHisLeuThrProLeuArgAspTrpAlaHisAsnGlyLeuArg
 961 CTGGCACCTATGTTTATAACCATCTCACTCCTCTTCGGGACTGGGCGCACAACGGCTTGC
     GACCGTGGATACAAATATTGGTAGAGTGAGGAGAAGCCCTGACCCGCGTGTTGCCGAACG

AspLeuAlaValAlaValGluProValValPheSerGlnMetGluThrLysLeuIleThr
1021 GAGATCTGGCCGTGGCTGTAGAGCCAGTCGTCTTCTCCCAAATGGAGACCAAGCTCATCA
     CTCTAGACCGGCACCGACATCTCGGTCAGCAGAAGAGGGTTTACCTCTGGTTCGAGTAGT

TrpGlyAlaAspThrAlaAlaCysGlyAspIleIleAsnGlyLeuProValSerAlaArg
1081 CGTGGGGGGCAGATACCGCCGCGTGCGGTGACATCATCAACGGCTTGCCTGTTTCCGCCC
     GCACCCCCCGTCTATGGCGGCGCACGCCACTGTAGTAGTTGCCGAACGGACAAAGGCGGG

ArgGlyArgGluIleLeuLeuGlyProAlaAspGlyMetValSerLysGlyTrpArgLeu
1141 GCAGGGGCCGGGAGATACTGCTCGGGCCAGCCGATGGAATGGTCTCCAAGGGGTGGAGGT
     CGTCCCCGGCCCTCTATGACGAGCCCGGTCGGCTACCTTACCAGAGGTTCCCCACCTCCA

LeuAlaProIleThrAlaTyrAlaGlnGlnThrArgGlyLeuLeuGlyCysIleIleThr
1201 TGCTGGCGCCCATCACGGCGTACGCCCAGCAGACAAGGGGCCTCCTAGGGTGCATAATCA
     ACGACCGCGGGTAGTGCCGCATGCGGGTCGTCTGTTCCCCGGAGGATCCCACGTATTAGT

SerLeuThrGlyArgAspLysAsnGlnValGluGlyGluValGlnIleValSerThrAla
1261 CCAGCCTAACTGGCCGGGACAAAAACCAAGTGGAGGGTGAGGTCCAGATTGTGTCAACTG
     GGTCGGATTGACCGGCCCTGTTTTTGGTTCACCTCCCACTCCAGGTCTAACACAGTTGAC

AlaGlnThrPheLeuAlaThrCysIleAsnGlyValCysTrpThrValTyrHisGlyAla
1321 CTGCCCAAACCTTCCTGGCAACGTGCATCAATGGGGTGTGCTGGACTGTCTACCACGGGG
     GACGGGTTTGGAAGGACCGTTGCACGTAGTTACCCCACACGACCTGACAGATGGTGCCCC

GlyThrArgThrIleAlaSerProLysGlyProValIleGlnMetTyrThrAsnValAsp
1381 CCGGAACGAGGACCATCGCGTCACCCAAGGGTCCTGTCATCCAGATGTATACCAATGTAG
     GGCCTTGCTCCTGGTAGCGCAGTGGGTTCCCAGGACAGTAGGTCTACATATGGTTACATC

GlnAspLeuValGlyTrpProAlaProGlnGlySerArgSerLeuThrProCyrThrCys
1441 ACCAAGACCTTGTGGGCTGGCCCGCTCCGCAAGGTAGCCGCTCATTGACACCCTGCACTT
     TGGTTCTGGAACACCCGACCGGGCGAGGCGTTCCATCGGCGAGTAACTGTGGGACGTGAA

GlySerSerAspLeuTyrLeuValThrArgHisAlaAspValIleProValArgArgArg
1501 GCGGCTCCTCGGACCTTTACCTGGTCACGAGGCACGCCGATGTCATTCCCGTGCGCCGGC
     CGCCGAGGAGCCTGGAAATGGACCAGTGCTCCGTGCGGCTACAGTAAGGGCACGCGGCCG

GlyAspSerArgGlySerLeuLeuSerProArgProIleSerTyrLeuLysGlySerSer
1561 GGGGTGATAGCAGGGGCAGCCTGCTGTCGCCCCGGCCCATTTCCTACTTGAAAGGCTCCT
     CCCCACTATCGTCCCCGTCGGACGACAGCTGGGCCGGGTAAAGGATGAACTTTCCGAGGA

GlyGlyProLeuLeuCysProAlaGlyHisAlaValGlyIlePheArgAlaAlaValCys
1621 CGGGGGGTCCGCTGTTGTGCCCCGCGGGGCACGCCGTGGGCATATTTAGGGCCGCGGTGT
     GCCCCCCAGGCGACAACACGGGGCGCCCCGTGCGGCACCCGTATAAATCCCGGCGCCACA

ThrArgGlyValAlaLysAlaValAspPheIleProValGluAsnLeuGluThrThrMet
1681 GCACCCGTGGAGTGGCTAAGGCGGTGGACTTTATCCCTGTGGAGAACCTAGAGACAACCA
     CGTGGGCACCTCACCGATTCCGCCACCTGAAATAGGGACACCTCTTGGATCTCTGTTGGT
```

FIG. 32C

```
          ArgSerProValPheThrAspAsnSerSerProProValValProGlnSerPheGlnVal
1741 TGAGGTCCCCGGTGTTCACGGATAACTCCTCTCCACCAGTAGTGCCCCAGAGCTTCCAGG
     ACTCCAGGGGCCACAAGTGCCTATTGAGGAGAGGTGGTCATCACGGGGTCTCGAAGGTCC

AlaHisLeuHisAlaProThrGlySerGlyLysSerThrLysValProAlaAlaTyrAla
1801 TGGCTCACCTCCATGCTCCCACAGGCAGCGGCAAAAGCACCAAGGTCCCGGCTGCATATG
     ACCGAGTGGAGGTACGAGGGTGTCCGTCGCCGTTTTCGTGGTTCCAGGGCCGACGTATAC

AlaGlnGlyTyrLysValLeuValLeuAsnProSerValAlaAlaThrLeuGlyPheGly
1861 CAGCTCAGGGCTATAAGGTGCTAGTACTCAACCCCTCTGTTGCTGCAACACTGGGCTTTG
     GTCGAGTCCCGATATTCCACGATCATGAGTTGGGGAGACAACGACGTTGTGACCCGAAAC

AlaTyrMetSerLysAlaHisGlyIleAspProAsnIleArgThrGlyValArgThrIle
1921 GTGCTTACATGTCCAAGGCTCATGGGATCGATCCTAACATCAGGACCGGGGTGAGAACAA
     CACGAATGTACAGGTTCCGAGTACCCTAGCTAGGATTGTAGTCCTGGCCCCACTCTTGTT

ThrThrGlySerProIleThrTyrSerThrTyrGlyLysPheLeuAlaAspGlyGlyCys
1981 TTACCACTGGCAGCCCCATCACGTACTCCACCTACGGCAAGTTCCTTGCCGACGGCGGGT
     AATGGTGACCGTCGGGGTAGTGCATGAGGTGGATGCCGTTCAAGGAACGGCTGCCGCCCA

SerGlyGlyAlaTyrAspIleIleIleCysAspGluCysHisSerThrAspAlaThrSer
2041 GCTCGGGGGGCGCTTATGACATAATAATTTGTGACGAGTGCCACTCCACGGATGCCACAT
     CGAGCCCCCCGCGAATACTGTATTATTAAACACTGCTCACGGTGAGGTGCCTACGGTGTA

IleLeuGlyIleGlyThrValLeuAspGlnAlaGluThrAlaGlyAlaArgLeuValVal
2101 CCATCTTGGGCATCGGCACTGTCCTTGACCAAGCAGAGACTGCGGGGGCGAGACTGGTTG
     GGTAGAACCCGTAGCCGTGACAGGAACTGGTTCGTCTCTGACGCCCCCGCTCTGACCAAC

LeuAlaThrAlaThrProProGlySerValThrValProHisProAsnIleGluGluVal
2161 TGCTCGCCACCGCCACCCCTCCGGGCTCCGTCACTGTGCCCCATCCCAACATCGAGGAGG
     ACGAGCGGTGGCGGTGGGGAGGCCCGAGGCAGTGACACGGGGTAGGGTTGTAGCTCCTCC

AlaLeuSerThrThrGlyGluIleProPheTyrGlyLysAlaIleProLeuGluValIle
2221 TTGCTCTGTCCACCACCGGAGAGATCCCTTTTTACGGCAAGGCTATCCCCCTCGAAGTAA
     AACGAGACAGGTGGTGGCCTCTCTAGGGAAAAATGCCGTTCCGATAGGGGGAGCTTCATT

LysGlyGlyArgHisLeuIlePheCysHisSerLysLysLysCysAspGluLeuAlaAla
2281 TCAAGGGGGGGAGACATCTCATCTTCTGTCATTCAAAGAAGAAGTGCGACGAACTCGCCG
     AGTTCCCCCCCTCTGTAGAGTAGAAGACAGTAAGTTTCTTCTTCACGCTGCTTGAGCGGC

LysLeuValAlaLeuGlyIleAsnAlaValAlaTyrTyrArgGlyLeuAspValSerVal
2341 CAAAGCTGGTCGCATTGGGCATCAATGCCGTGGCCTACTACCGCGGTCTTGACGTGTCCG
     GTTTCGACCAGCGTAACCCGTAGTTACGGCACCGGATGATGGCGCCAGAACTGCACAGGC

IleProThrSerGlyAspValValValValAlaThrAspAlaLeuMetThrGlyTyrThr
2401 TCATCCCGACCAGCGGCGATGTTGTCGTCGTGGCAACCGATGCCCTCATGACCGGCTATA
     AGTAGGGCTGGTCGCCGCTACAACAGCAGCACCGTTGGCTACGGGAGTACTGGCCGATAT

GlyAspPheAspSerValIleAspCysAsnThrCysValThrGlnThrValAspPheSer
2461 CCGGCGACTTCGACTCGGTGATAGACTGCAATACGTGTGTCACCCAGACAGTCGATTTCA
     GGCCGCTGAAGCTGAGCCACTATCTGACGTTATGCACACAGTGGGTCTGTCAGCTAAAGT

LeuAspProThrPheThrIleGluThrIleThrLeuProGlnAspAlaValSerArgThr
2521 GCCTTGACCCTACCTTCACCATTGAGACAATCACGCTCCCCCAGGATGCTGTCTCCCGCA
     CGGAACTGGGATGGAAGTGGTAACTCTGTTAGTGCGAGGGGGTCCTACGACAGAGGGCGT

GlnArgArgGlyArgThrGlyArgGlyLysProGlyIleTyrArgPheValAlaProGly
2581 CTCAACGTCGGGGCAGGACTGGCAGGGGGAAGCCAGGCATCTACAGATTTGTGGCACCGG
     GAGTTGCAGCCCCGTCCTGACCGTCCCCCTTCGGTCCGTAGATGTCTAAACACCGTGGCC

GluArgProSerGlyMetPheAspSerSerValLeuCysGluCysTyrAspAlaGlyCys
2641 GGGAGCGCCCCTCCGGCATGTTCGACTCGTCCGTCCTCTGTGAGTGCTATGACGCAGGCT
     CCCTCGCGGGGAGGCCGTACAAGCTGAGCAGGCAGGAGACACTCACGATACTGCGTCCGA

AlaTrpTyrGluLeuThrProAlaGluThrThrValArgLeuArgAlaTyrMetAsnThr
2701 GTGCTTGGTATGAGCTCACGCCCGCCGAGACTACAGTTAGGCTACGAGCGTACATGAACA
     CACGAACCATACTCGAGTGCGGGCGGCTCTGATGTCAATCCGATGCTCGCATGTACTTGT
```

FIG. 32D

```
         ProGlyLeuProValCysGlnAspHisLeuGluPheTrpGluGlyValPheThrGlyLeu
2761 CCCGGGGCTTCCCGTGTGCCAGGACCATCTTGAATTTTGGGAGGGCGTCTTTACAGGCC
     GGGGCCCCGAAGGGCACACGGTCCTGGTAGAACTTAAAACCCTCCCGCAGAAATGTCCGG

ThrHisIleAspAlaHisPheLeuSerGlnThrLysGlnSerGlyGluAsnLeuProTyr
2821 TCACTCATATAGATGCCCACTTTCTATCCCAGACAAAGCAGAGTGGGGAGAACCTTCCTT
     AGTGAGTATATCTACGGGTGAAAGATAGGGTCTGTTTCGTCTCACCCCTCTTGGAAGGAA

LeuValAlaTyrGlnAlaThrValCysAlaArgAlaGlnAlaProProProSerTrpAsp
2881 ACCTGGTAGCGTACCAAGCCACCGTGTGCGCTAGGGCTCAAGCCCCTCCCCCATCGTGGG
     TGGACCATCGCATGGTTCGGTGGCACACGCGATCCCGAGTTCGGGGAGGGGGTAGCACCC

GlnMetTrpLysCysLeuIleArgLeuLysProThrLeuHisGlyProThrProLeuLeu
2941 ACCAGATGTGGAAGTGTTTGATTCGCCTCAAGCCCACCCTCCATGGGCCAACACCCCTGC
     TGGTCTACACCTTCACAAACTAAGCGGAGTTCGGGTGGGAGGTACCCGGTTGTGGGGACG

TyrArgLeuGlyAlaValGlnAsnGluIleThrLeuThrHisProValThrLysTyrIle
3001 TATACAGACTGGGCGCTGTTCAGAATGAAATCACCCTGACGCACCCAGTCACCAAATACA
     ATATGTCTGACCCGCGACAAGTCTTACTTTAGTGGGACTGCGTGGGTCAGTGGTTTATGT

MetThrCysMetSerAlaAspLeuGluValValThrSerThrTrpValLeuValGlyGly
3061 TCATGACATGCATGTCGGCCGACCTGGAGGTCGTCACGAGCACCTGGGTGCTCGTTGGCG
     AGTACTGTACGTACAGCCGGCTGGACCTCCAGCAGTGCTCGTGGACCCACGAGCAACCGC

ValLeuAlaAlaLeuAlaAlaTyrCysLeuSerThrGlyCysValValIleValGlyArg
3121 GCGTCCTGGCTGCTTTGGCCGCGTATTGCCTGTCAACAGGCTGCGTGGTCATAGTGGGCA
     CGCAGGACCGACGAAACCGGCGCATAACGGACAGTTGTCCGACGCACCAGTATCACCCGT

ValValLeuSerGlyLysProAlaIleIleProAspArgGluValLeuTyrArgGluPhe
3181 GGGTCGTCTTGTCCGGGAAGCCGGCAATCATACCTGACAGGGAAGTCCTCTACCGAGAGT
     CCCAGCAGAACAGGCCCTTCGGCCGTTAGTATGGACTGTCCCTTCAGGAGATGGCTCTCA

AspGluMetGluGluCysSerGlnHisLeuProTyrIleGluGlnGlyMetMetLeuAla
3241 TCGATGAGATGGAAGAGTGCTCTCAGCACTTACCGTACATCGAGCAAGGGATGATGCTCG
     AGCTACTCTACCTTCTCACGAGAGTCGTGAATGGCATGTAGCTCGTTCCCTACTACGAGC

GluGlnPheLysGlnLysAlaLeuGlyLeuLeuGlnThrAlaSerArgGlnAlaGluVal
3301 CCGAGCAGTTCAAGCAGAAGGCCCTCGGCCTCCTGCAGACCGCGTCCCGTCAGGCAGAGG
     GGCTCGTCAAGTTCGTCTTCCGGGAGCCGGAGGACGTCTGGCGCAGGGCAGTCCGTCTCC

IleAlaProAlaValGlnThrAsnTrpGlnLysLeuGluThrPheTrpAlaLysHisMet
3361 TTATCGCCCCTGCTGTCCAGACCAACTGGCAAAAACTCGAGACCTTCTGGGCGAAGCATA
     AATAGCGGGGACGACAGGTCTGGTTGACCGTTTTTGAGCTCTGGAAGACCCGCTTCGTAT

TrpAsnPheIleSerGlyIleGlnTyrLeuAlaGlyLeuSerThrLeuProGlyAsnPro
3421 TGTGGAACTTCATCAGTGGGATACAATACTTGGCGGGCTTGTCAACGCTGCCTGGTAACC
     ACACCTTGAAGTAGTCACCCTATGTTATGAACCGCCCGAACAGTTGCGACGGACCATTGG

AlaIleAlaSerLeuMetAlaPheThrAlaAlaValThrSerProLeuThrThrSerGln
3481 CCGCCATTGCTTCATTGATGGCTTTTACAGCTGCTGTCACCAGCCCACTAACCACTAGCC
     GGCGGTAACGAAGTAACTACCGAAAATGTCGACGACAGTGGTCGGGTGATTGGTGATCGG

ThrLeuLeuPheAsnIleLeuGlyGlyTrpValAlaAlaGlnLeuAlaAlaProGlyAla
3541 AAACCCTCCTCTTCAACATATTGGGGGGTGGGTGGCTGCCCAGCTCGCCGCCCCCGGTG
     TTTGGGAGGAGAAGTTGTATAACCCCCCCACCCACCGACGGGTCGAGCGGCGGGGGCCAC

AlaThrAlaPheValGlyAlaGlyLeuAlaGlyAlaAlaIleGlySerValGlyLeuGly
3601 CCGCTACTGCCTTTGTGGGCGCTGGCTTAGCTGGCGCCGCCATCGGCAGTGTTGGACTGG
     GGCGATGACGGAAACACCCGCGACCGAATCGACCGCGGCGGTAGCCGTCACAACCTGACC

LysValLeuIleAspIleLeuAlaGlyTyrGlyAlaGlyValAlaGlyAlaLeuValAla
3661 GGAAGGTCCTCATAGACATCCTTGCAGGGTATGGCGCGGGCGTGGCGGGAGCTCTTGTGG
     CCTTCCAGGAGTATCTGTAGGAACGTCCCATACCGCGCCCGCACCGCCCTCGAGAACACC

PheLysIleMetSerGlyGluValProSerThrGluAspLeuValAsnLeuLeuProAla
3721 CATTCAAGATCATGAGCGGTGAGGTCCCCTCCACGGAGGACCTGGTCAATCTACTGCCCG
     GTAAGTTCTAGTACTCGCCACTCCAGGGGAGGTGCCTCCTGGACCAGTTAGATGACGGGC
```

FIG. 32E

```
         IleLeuSerProGlyAlaLeuValValGlyValValCysAlaAlaIleLeuArgArgHis
3781 CCATCCTCTCGCCCGGAGCCCTCGTAGTCGGCGTGGTCTGTGCAGCAATACTGCGCCGGC
     GGTAGGAGAGCGGGCCTCGGGAGCATCAGCCGCACCAGACACGTCGTTATGACGCGGCCG

ValGlyProGlyGluGlyAlaValGlnTrpMetAsnArgLeuIleAlaPheAlaSerArg
3841 ACGTTGGCCCGGGCGAGGGGGCAGTGCAGTGGATGAACCGGCTGATAGCCTTCGCCTCCC
     TGCAACCGGGCCCGCTCCCCCGTCACGTCACCTACTTGGCCGACTATCGGAAGCGGAGGG

GlyAsnHisValSerProThrHisTyrValProGluSerAspAlaAlaAlaArgValThr
3901 GGGGGAACCATGTTTCCCCCACGCACTACGTGCCGGAGAGCGATGCAGCTGCCCGCGTCA
     CCCCCTTGGTACAAAGGGGGTGCGTGATGCACGGCCTCTCGCTACGTCGACGGGCGCAGT

AlaIleLeuSerSerLeuThrValThrGlnLeuLeuArgArgLeuHisGlnTrpIleSer
3961 CTGCCATACTCAGCAGCCTCACTGTAACCCAGCTCCTGAGGCGACTGCACCAGTGGATAA
     GACGGTATGAGTCGTCGGAGTGACATTGGGTCGAGGACTCCGCTGACGTGGTCACCTATT

SerGluCysThrThrProCysSerGlySerTrpLeuArgAspIleTrpAspTrpIleCys
4021 GCTCGGAGTGTACCACTCCATGCTCCGGTTCCTGGCTAAGGGACATCTGGGACTGGATAT
     CGAGCCTCACATGGTGAGGTACGAGGCCAAGGACCGATTCCCTGTAGACCCTGACCTATA

GluValLeuSerAspPheLysThrTrpLeuLysAlaLysLeuMetProGlnLeuProGly
4081 GCGAGGTGTTGAGCGACTTTAAGACCTGGCTAAAAGCTAAGCTCATGCCACAGCTGCCTG
     CGCTCCACAACTCGCTGAAATTCTGGACCGATTTTCGATTCGAGTACGGTGTCGACGGAC

IleProPheValSerCysGlnArgGlyTyrLysGlyValTrpArgValAspGlyIleMet
4141 GGATCCCCTTTGTGTCCTGCCAGCGCGGGTATAAGGGGGTCTGGCGAGTGGACGGCATCA
     CCTAGGGGAAACACAGGACGGTCGCGCCCATATTCCCCCAGACCGCTCACCTGCCGTAGT

HisThrArgCysHisCysGlyAlaGluIleThrGlyHisValLysAsnGlyThrMetArg
4201 TGCACACTCGCTGCCACTGTGGAGCTGAGATCACTGGACATGTCAAAAACGGGACGATGA
     ACGTGTGAGCGACGGTGACACCTCGACTCTAGTGACCTGTACAGTTTTTGCCCTGCTACT

IleValGlyProArgThrCysArgAsnMetTrpSerGlyThrPheProIleAsnAlaTyr
4261 GGATCGTCGGTCCTAGGACCTGCAGGAACATGTGGAGTGGGACCTTCCCCATTAATGCCT
     CCTAGCAGCCAGGATCCTGGACGTCCTTGTACACCTCACCCTGGAAGGGGTAATTACGGA

ThrThrGlyProCysThrProLeuProAlaProAsnTyrThrPheAlaLeuTrpArgVal
4321 ACACCACGGGCCCCTGTACCCCCCTTCCTGCGCCGAACTACACGTTCGCGCTATGGAGGG
     TGTGGTGCCCGGGGACATGGGGGGAAGGACGCGGCTTGATGTGCAAGCGCGATACCTCCC

SerAlaGluGluTyrValGluIleArgGlnValGlyAspPheHisTyrValThrGlyMet
4381 TGTCTGCAGAGGAATATGTGGAGATAAGGCAGGTGGGGGACTTCCACTACGTGACGGGTA
     ACAGACGTCTCCTTATACACCTCTATTCCGTCCACCCCCTGAAGGTGATGCACTGCCCAT

ThrThrAspAsnLeuLysCysProCysGlnValProSerProGluPhePheThrGluLeu
4441 TGACTACTGACAATCTCAAATGCCCGTGCCAGGTCCCATCGCCCGAATTTTTCACAGAAT
     ACTGATGACTGTTAGAGTTTACGGGCACGGTCCAGGGTAGCGGGCTTAAAAAGTGTCTTA

AspGlyValArgLeuHisArgPheAlaProProCysLysProLeuLeuArgGluGluVal
4501 TGGACGGGGTGCGCCTACATAGGTTTGCGCCCCCCTGCAAGCCCTTGCTGCGGGAGGAGG
     ACCTGCCCCACGCGGATGTATCCAAACGCGGGGGGACGTTCGGGAACGACGCCCTCCTCC

SerPheArgValGlyLeuHisGluTyrProValGlySerGlnLeuProCysGluProGlu
4561 TATCATTCAGAGTAGGACTCCACGAATACCCGGTAGGGTCGCAATTACCTTGCGAGCCCG
     ATAGTAAGTCTCATCCTGAGGTGCTTATGGGCCATCCCAGCGTTAATGGAACGCTCGGGC

ProAspValAlaValLeuThrSerMetLeuThrAspProSerHisIleThrAlaGluAla
4621 AACCGGACGTGGCCGTGTTGACGTCCATGCTCACTGATCCCTCCCATATAACAGCAGAGG
     TTGGCCTGCACCGGCACAACTGCAGGTACGAGTGACTAGGGAGGGTATATTGTCGTCTCC

AlaGlyArgArgLeuAlaArgGlySerProProSerValAlaSerSerSerAlaSerGln
4681 CGGCCGGGCGAAGGTTGGCGAGGGGATCACCCCCCTCTGTGGCCAGCTCCTCGGCTAGCC
     GCCGGCCCGCTTCCAACCGCTCCCCTAGTGGGGGGAGACACCGGTCGAGGAGCCGATCGG

LeuSerAlaProSerLeuLysAlaThrCysThrAlaAsnHisAspSerProAspAlaGlu
4741 AGCTATCCGCTCCATCTCTCAAGGCAACTTGCACCGCTAACCATGACTCCCCTGATGCTG
     TCGATAGGCGAGGTAGAGAGTTCCGTTGAACGTGGCGATTGGTACTGAGGGGACTACGAC
```

FIG. 32F

```
          LeuIleGluAlaAsnLeuLeuTrpArgGlnGluMetGlyGlyAsnIleThrArgValGlu
4801 AGCTCATAGAGGCCAACCTCCTATGGAGGCAGGAGATGGGCGGCAACATCACCAGGGTTG
     TCGAGTATCTCCGGTTGGAGGATACCTCCGTCCTCTACCCGCCGTTGTAGTGGTCCCAAC

SerGluAsnLysValValIleLeuAspSerPheAspProLeuValAlaGluGluAspGlu
4861 AGTCAGAAAACAAAGTGGTGATTCTGGACTCCTTCGATCCGCTTGTGGCGGAGGAGGACG
     TCAGTCTTTTGTTTCACCACTAAGACCTGAGGAAGCTAGGCGAACACCGCCTCCTCCTGC

ArgGluIleSerValProAlaGluIleLeuArgLysSerArgArgPheAlaGlnAlaLeu
4921 AGCGGGAGATCTCCGTACCCGCAGAAATCCTGCGGAAGTCTCGGAGATTCGCCCAGGCCC
     TCGCCCTCTAGAGGCATGGGCGTCTTTAGGACGCCTTCAGAGCCTCTAAGCGGGTCCGGG

ProValTrpAlaArgProAspTyrAsnProProLeuValGluThrTrpLysLysProAsp
4981 TGCCCGTTTGGGCGCGGCCGGACTATAACCCCCCGCTAGTGGAGACGTGGAAAAAGCCCG
     ACGGGCAAACCCGCGCCGGCCTGATATTGGGGGGCGATCACCTCTGCACCTTTTTCGGGC

TyrGluProProValValHisGlyCysProLeuProProProLysSerProProValPro
5041 ACTACGAACCACCTGTGGTCCATGGCTGTCCGCTTCCACCTCCAAAGTCCCCTCCTGTGC
     TGATGCTTGGTGGACACCAGGTACCGACAGGCGAAGGTGGAGGTTTCAGGGGAGGACACG

ProProArgLysLysArgThrValValLeuThrGluSerThrLeuSerThrAlaLeuAla
5101 CTCCGCCTCGGAAGAAGCGGACGGTGGTCCTCACTGAATCAACCCTATCTACTGCCTTGG
     GAGGCGGAGCCTTCTTCGCCTGCCACCAGGAGTGACTTAGTTGGGATAGATGACGGAACC

GluLeuAlaThrArgSerPheGlySerSerSerThrSerGlyIleThrGlyAspAsnThr
5161 CCGAGCTCGCCACCAGAAGCTTTGGCAGCTCCTCAACTTCCGGCATTACGGGCGACAATA
     GGCTCGAGCGGTGGTCTTCGAAACCGTCGAGGAGTTGAAGGCCGTAATGCCCGCTGTTAT

ThrThrSerSerGluProAlaProSerGlyCysProProAspSerAspAlaGluSerTyr
5221 CGACAACATCCTCTGAGCCCGCCCCTTCTGGCTGCCCCCCCGACTCCGACGCTGAGTCCT
     GCTGTTGTAGGAGACTCGGGCGGGGAAGACCGACGGGGGGGCTGAGGCTGCGACTCAGGA

SerSerMetProProLeuGluGlyGluProGlyAspProAspLeuSerAspGlySerTrp
5281 ATTCCTCCATGCCCCCCCTGGAGGGGGAGCCTGGGGATCCGGATCTTAGCGACGGGTCAT
     TAAGGAGGTACGGGGGGGACCTCCCCCTCGGACCCCTAGGCCTAGAATCGCTGCCCAGTA

SerThrValSerSerGluAlaAsnAlaGluAspValValCysCysSerMetSerTyrSer
5341 GGTCAACGGTCAGTAGTGAGGCCAACGCGGAGGATGTCGTGTGCTGCTCAATGTCTTACT
     CCAGTTGCCAGTCATCACTCCGGTTGCGCCTCCTACAGCACACGACGAGTTACAGAATGA

TrpThrGlyAlaLeuValThrProCysAlaAlaGluGluGlnLysLeuProIleAsnAla
5401 CTTGGACAGGCGCACTCGTCACCCCGTGCGCCGCGGAAGAACAGAAACTGCCCATCAATG
     GAACCTGTCCGCGTGAGCAGTGGGGCACGCGGCGCCTTCTTGTCTTTGACGGGTAGTTAC

LeuSerAsnSerLeuLeuArgHisHisAsnLeuValTyrSerThrThrSerArgSerAla
5461 CACTAAGCAACTCGTTGCTACGTCACCACAATTTGGTGTATTCCACCACCTCACGCAGTG
     GTGATTCGTTGAGCAACGATGCAGTGGTGTTAAACCACATAAGGTGGTGGAGTGCGTCAC

CysGlnArgGlnLysLysValThrPheAspArgLeuGlnValLeuAspSerHisTyrGln
5521 CTTGCCAAAGGCAGAAGAAAGTCACATTTGACAGACTGCAAGTTCTGGACAGCCATTACC
     GAACGGTTTCCGTCTTCTTTCAGTGTAAACTGTCTGACGTTCAAGACCTGTCGGTAATGG

AspValLeuLysGluValLysAlaAlaAlaSerLysValLysAlaAsnLeuLeuSerVal
5581 AGGACGTACTCAAGGAGGTTAAAGCAGCGGCGTCAAAAGTGAAGGCTAACTTGCTATCCG
     TCCTGCATGAGTTCCTCCAATTTCGTCGCCGCAGTTTTCACTTCCGATTGAACGATAGGC

GluGluAlaCysSerLeuThrProProHisSerAlaLysSerLysPheGlyTyrGlyAla
5641 TAGAGGAAGCTTGCAGCCTGACGCCCCCACACTCAGCCAAATCCAAGTTTGGTTATGGGG
     ATCTCCTTCGAACGTCGGACTGCGGGGGTGTGAGTCGGTTTAGGTTCAAACCAATACCCC

LysAspValArgCysHisAlaArgLysAlaValThrHisIleAsnSerValTrpLysAsp
5701 CAAAAGACGTCCGTTGCCATGCCAGAAAGGCCGTAACCCACATCAACTCCGTGTGGAAAG
     GTTTTCTGCAGGCAACGGTACGGTCTTTCCGGCATTGGGTGTAGTTGAGGCACACCTTTC

LeuLeuGluAspAsnValThrProIleAspThrThrIleMetAlaLysAsnGluValPhe
5761 ACCTTCTGGAAGACAATGTAACACCAATAGACACTACCATCATGGCTAAGAACGAGGTTT
     TGGAAGACCTTCTGTTACATTGTGGTTATCTGTGATGGTAGTACCGATTCTTGCTCCAAA
```

FIG. 32G

```
         CysValGlnProGluLysGlyGlyArgLysProAlaArgLeuIleValPheProAspLeu
5821 TCTGCGTTCAGCCTGAGAAGGGGGGTCGTAAGCCAGCTCGTCTCATCGTGTTCCCCGATC
     AGACGCAAGTCGGACTCTTCCCCCCAGCATTCGGTCGAGCAGAGTAGCACAAGGGGCTAG

GlyValArgValCysGluLysMetAlaLeuTyrAspValValThrLysLeuProLeuAla
5881 TGGGCGTGCGCGTGTGCGAAAAGATGGCTTTGTACGACGTGGTTACAAAGCTCCCCTTGG
     ACCCGCACGCGCACACGCTTTTCTACCGAAACATGCTGCACCAATGTTTCGAGGGGAACC

ValMetGlySerSerTyrGlyPheGlnTyrSerProGlyGlnArgValGluPheLeuVal
5941 CCGTGATGGGAAGCTCCTACGGATTCCAATACTCACCAGGACAGCGGGTTGAATTCCTCG
     GGCACTACCCTTCGAGGATGCCTAAGGTTATGAGTGGTCCTGTCGCCCAACTTAAGGAGC

GlnAlaTrpLysSerLysLysThrProMetGlyPheSerTyrAspThrArgCysPheAsp
6001 TGCAAGCGTGGAAGTCCAAGAAAACCCCAATGGGGTTCTCGTATGATACCCGCTGCTTTG
     ACGTTCGCACCTTCAGGTTCTTTTGGGGTTACCCCAAGAGCATACTATGGGCGACGAAAC

SerThrValThrGluSerAspIleArgThrGluGluAlaIleTyrGlnCysCysAspLeu
6061 ACTCCACAGTCACTGAGAGCGACATCCGTACGGAGGAGGCAATCTACCAATGTTGTGACC
     TGAGGTGTCAGTGACTCTCGCTGTAGGCATGCCTCCTCCGTTAGATGGTTACAACACTGG

AspProGlnAlaArgValAlaIleLysSerLueThrGluArgLeuTyrValGlyGlyPro
6121 TCGACCCCCAAGCCCGCGTGGCCATCAAGTCCCTCACCGAGAGGCTTTATGTTGGGGGCC
     AGCTGGGGGTTCGGGCGCACCGGTAGTTCAGGGAGTGGCTCTCCGAAATACAACCCCCGG

LeuThrAsnSerArgGlyGluAsnCysGlyTyrArgArgCysArgAlaSerGlyValLeu
6181 CTCTTACCAATTCAAGGGGGGAGAACTGCGGCTATCGCAGGTGCCGCGCGAGCGGCGTAC
     GAGAATGGTTAAGTTCCCCCCTCTTGACGCCGATAGCGTCCACGGCGCGCTCGCCGCATG

ThrThrSerCysGlyAsnThrLeuThrCysTyrIleLysAlaArgAlaAlaCysArgAla
6241 TGACAACTAGCTGTGGTAACACCCTCACTTGCTACATCAAGGCCCGGGCAGCCTGTCGAG
     ACTGTTGATCGACACCATTGTGGGAGTGAACGATGTAGTTCCGGGCCCGTCGGACAGCTC

AlaGlyLeuGlnAspCysThrMetLeuValCysGlyAspAspLeuValValIleCysGlu
6301 CCGCAGGGCTCCAGGACTGCACCATGCTCGTGTGTGGCGACGACTTAGTCGTTATCTGTG
     GGCGTCCCGAGGTCCTGACGTGGTACGAGCACACACCGCTGCTGAATCAGCAATAGACAC

SerAlaGlyValGlnGluAspAlaAlaSerLeuArgAlaPheThrGluAlaMetThrArg
6361 AAAGCGCGGGGGTCCAGGAGGACGCGGCGAGCCTGAGAGCCTTCACGGAGGCTATGACCA
     TTTCGCGCCCCCAGGTCCTCCTGCGCCGCTCGGACTCTCGGAAGTGCCTCCGATACTGGT

TyrSerAlaProProGlyAspProProGlnProGluTyrAspLeuGluLeuIleThrSer
6421 GGTACTCCGCCCCCCCTGGGGACCCCCCACAACCAGAATACGACTTGGAGCTCATAACAT
     CCATGAGGCGGGGGGGACCCCTGGGGGGTGTTGGTCTTATGCTGAACCTCGAGTATTGTA

CysSerSerAsnValSerValAlaHisAspGlyAlaGlyLysArgValTyrTyrLeuThr
6481 CATGCTCCTCCAACGTGTCAGTCGCCCACGACGGCGCTGGAAAGAGGGTCTACTACCTCA
     GTACGAGGAGGTTGCACAGTCAGCGGGTGCTGCCGCGACCTTTCTCCCAGATGATGGAGT

ArgAspProThrThrProLeuAlaArgAlaAlaTrpGluThrAlaArgHisThrProVal
6541 CCCGTGACCCTACAACCCCCCTCGCGAGAGCTGCGTGGGAGACAGCAAGACACACTCCAG
     GGGCACTGGGATGTTGGGGGAGCGCTCTCGACGCACCCTCTGTCGTTCTGTGTGAGGTC

AsnSerTrpLeuGlyAsnIleIleMetPheAlaProThrLeuTrpAlaArgMetIleLeu
6601 TCAATTCCTGGCTAGGCAACATAATCATGTTTGCCCCCACACTGTGGGCGAGGATGATAC
     AGTTAAGGACCGATCCGTTGTATTAGTACAAACGGGGGTGTGACACCCGCTCCTACTATG

MetThrHisPhePheSerValLeuIleAlaArgAspGlnLeuGluGlnAlaLeuAspCys
6661 TGATGACCCATTTCTTTAGCGTCCTTATAGCCAGGGACCAGCTTGAACAGGCCCTCGATT
     ACTACTGGGTAAAGAAATCGCAGGAATATCGGTCCCTGGTCGAACTTGTCCGGGAGCTAA

GluIleTyrGlyAlaCysTyrSerIleGluProLeuAspLeuProProIleIleGlnArg
6721 GCGAGATCTACGGGGCCTGCTACTCCATAGAACCACTTGATCTACCTCCAATCATTCAAA
     CGCTCTAGATGCCCCGGACGATGAGGTATCTTGGTGAACTAGATGGAGGTTAGTAAGTTT

Leu
6781 GACTC
     CTGAG
```

FIG. 33

| Lane Number | Chimp Reference Number | Infection Type | Sample date (days) (0=inoculation day) | ALT (alanine) aminotransferase level in sera)mµ/ml) |
|---|---|---|---|---|
| 1 | 1 | NANB | 0 | 0 |
| 2 | 1 | NANB | 76 | 71 |
| 3 | 1 | NANB | 118 | 19 |
| 4 | 1 | NANB | 154 | N/A |
| 5 | 2 | NANB | 0 | 0 |
| 6 | 2 | NANB | 21 | 52 |
| 7 | 2 | NANB | 73 | 13 |
| 8 | 2 | NANB | 138 | N/A |
| 9 | 3 | NANB | 0 | 8 |
| 10 | 3 | NANB | 43 | 205 |
| 11 | 3 | NANB | 53 | 14 |
| 12 | 3 | NANB | 159 | 6 |
| 13 | 4 | NANB | -3 | 11 |
| 14 | 4 | NANB | 55 | 132 |
| 15 | 4 | NANB | 83 | N/A |
| 16 | 4 | NANB | 140 | N/A |
| 17 | 5 | HAV | 0 | 4 |
| 18 | 5 | HAV | 25 | 147 |
| 19 | 5 | HAV | 40 | 18 |
| 20 | 5 | HAV | 268 | 5 |
| 21 | 6 | HAV | -8 | N/A |
| 22 | 6 | HAV | 15 | 100 |
| 23 | 6 | HAV | 41 | 10 |
| 24 | 6 | HAV | 129 | N/A |
| 26 | 7 | HAV | 0 | 7 |
| 27 | 7 | HAV | 22 | 83 |
| 28 | 7 | HAV | 115 | 5 |
| 29 | 7 | HAV | 139 | N/A |
| 30 | 8 | HAV | 0 | 15 |
| 31 | 8 | HAV | 26 | 130 |
| 32 | 8 | HAV | 74 | 8 |
| 33 | 8 | HAV | 205 | 5 |
| 34 | 9 | HBV | -290 | N/A |
| 35 | 9 | HBV | 379 | 9 |
| 36 | 9 | HBV | 435 | 6 |
| 37 | 10 | HBV | 0 | 8 |
| 38 | 10 | HBV | 111-118 (pool) | 96-156 (pool) |
| 39 | 10 | HBV | 205 | 9 |
| 40 | 10 | HBV | 240 | 13 |
| 41 | 11 | HBV | 0 | 11 |
| 42 | 11 | HBV | 28-56 (pool) | 8-100 (pool) |
| 43 | 11 | HBV | 169 | 9 |
| 44 | 11 | HBV | 223 | 10 |

FIG. 34

| Lane Number | Patient Reference Number | Diagnosis | ALT Level (mμ/ml) |
|---|---|---|---|
| 1 | 1[1] | NANB | 1354 |
| 2 | 1[1] | NANB | 31 |
| 3 | 2[1] | NANB | 14 |
| 4 | 2[1] | NANB | 79 |
| 5 | 2[1] | NANB | 26 |
| 6 | 3[1] | NANB | 78 |
| 7 | 3[1] | NANB | 87 |
| 8 | 3[1] | NANB | 25 |
| 9 | 4[1] | NANB | 60 |
| 10 | 4[1] | NANB | 13 |
| 11 | 5[1] | NANB | 298 |
| 12 | 5[1] | NANB | 101 |
| 13 | 6[1] | NANB | 474 |
| 14 | 6[1] | NANB | 318 |
| 15 | 7[1] | NANB | 20 |
| 16 | 7[1] | NANB | 163 |
| 17 | 8[1] | NANB | 44 |
| 18 | 8[1] | NANB | 50 |
| 19 | 9 | NANB | N/A |
| 20 | 10 | NANB | N/A |
| 21 | 11 | NANB | N/A |
| 22 | 12 | Normal | N/A |
| 23 | 13 | Normal | N/A |
| 24 | 14 | Normal | N/A |
| 26 | 30174 | Normal | N/A |
| 27 | 30105 | Normal | N/A |
| 28 | 30072 | Normal | N/A |
| 29 | 30026 | Normal | N/A |
| 30 | 30146 | Normal | N/A |
| 31 | 30250 | Normal | N/A |
| 32 | 30071 | Normal | N/A |
| 33 | 15 | AcuteHAV | N/A |
| 34 | 16 | AcuteHAV | N/A |
| 35 | 17 | AcuteHAV | N/A |
| 36 | 18 | AcuteHAV | N/A |
| 37 | 48088 | AcuteHAV | N/A |
| 38 | 47288 | AcuteHAV | N/A |
| 39 | 47050 | AcuteHAV | N/A |
| 40 | 46997 | AcuteHAV | N/A |
| 41 | 19 | Convalescent HBV | N/A |
| 42 | 20 | (anti-HBSag+ve; | N/A |
| 43 | 21 | anti-HBCag+ve) | N/A |
| 44 | 22 | (anti-HBSag+ve; | N/A |
| 45 | 23 | anti-HBCag+ve) | N/A |
| 46 | 24 | (anti-HBSag+ve; | N/A |
| 47 | 25 | anti-HBCag+ve) | N/A |
| 48 | 26 | (anti-HBSag+ve; | N/A |
| 49 | 27 | anti-HBSag+ve) | N/A |

[1]Sequential serum samples were assayed from these patients

FIG. 36A

```
         --------SOD------------COOH][--adaptor----][NANBHpolypeptide>
         AlaCysGlyValIleGlyIleAlaGlnAsnLeuGlyIleArgAspAlaHisPheLeuSer
    1    GCTTGTGGTGTAATTGGGATCGCCCAGAATTTGGGAATTCGGGATGCCCACTTTCTATCC
         CGAACACCACATTAACCCTAGCGGGTCTTAAACCCTTAAGCCCTACGGGTGAAAGATAGG >>>>>>>>>>>>>>>>>>>>>
         GlnThrLysGlnSerGlyGluAsnLeuProTyrLeuValAlaTyrGlnAlaThrValCys
   61    CAGACAAAGCAGAGTGGGGAGAACCTTCCTTACCTGGTAGCGTACCAAGCCACCGTGTGC
         GTCTGTTTCGTCTCACCCCTCTTGGAAGGAATGGACCATCGCATGGTTCGGTGGCACACG AlaArgAlaGlnAlaProProProSerTrpAspGlnMetTrpLysCysLeuIleArgLeu
  121    GCTAGGGCTCAAGCCCCTCCCCCATCGTGGGACCAGATGTGGAAGTGTTTGATTCGCCTC
         CGATCCCGAGTTCGGGGAGGGGGTAGCACCCTGGTCTACACCTTCACAAACTAAGCGGAG LysProThrLeuHisGlyProThrProLeuLeuTyrArgLeuGlyAlaValGlnAsnGlu
  181    AAGCCCACCCTCCATGGGCCAACACCCCTGCTATACAGACTGGGCGCTGTTCAGAATGAA
         TTCGGGTGGGAGGTACCCGGTTGTGGGGACGATATGTCTGACCCGCGACAAGTCTTACTT IleThrLeuThrHisProValThrLysTyrIleMetThrCysMetSerAlaAspLeuGlu
  241    ATCACCCTGACGCACCCAGTCACCAAATACATCATGACATGCATGTCGGCCGACCTGGAG
         TAGTGGGACTGCGTGGGTCAGTGGTTTATGTAGTACTGTACGTACAGCCGGCTGGACCTC ValValThrSerThrTrpValLeuValGlyGlyValLeuAlaAlaLeuAlaAlaTyrCys
  301    GTCGTCACGAGCACCTGGGTGCTCGTTGGCGGCGTCCTGGCTGCTTTGGCCGCGTATTGC
         CAGCAGTGCTCGTGGACCCACGAGCAACCGCCGCAGGACCGACGAAACCGGCGCATAACG LeuSerThrGlyCysValValIleValGlyArgValValLeuSerGlyLysProAlaIle
  361    CTGTCAACAGGCTGCGTGGTCATAGTGGGCAGGGTCGTCTTGTCCGGGAAGCCGGCAATC
         GACAGTTGTCCGACGCACCAGTATCACCCGTCCCAGCAGAACAGGCCCTTCGGCCGTTAG IleProAspArgGluValLeuTyrArgGluPheAspGluMetGluGluCysSerGlnHis
  421    ATACCTGACAGGGAAGTCCTCTACCGAGAGTTCGATGAGATGGAAGAGTGCTCTCAGCAC
         TATGGACTGTCCCTTCAGGAGATGGCTCTCAAGCTACTCTACCTTCTCACGAGAGTCGTG LeuProTyrIleGluGlnGlyMetMetLeuAlaGluGlnPheLysGlnLysAlaLeuGly
  481    TTACCGTACATCGAGCAAGGGATGATGCTCGCCGAGCAGTTCAAGCAGAAGGCCCTCGGC
         AATGGCATGTAGCTCGTTCCCTACTACGAGCGGCTCGTCAAGTTCGTCTTCCGGGAGCCG LeuLeuGlnThrAlaSerArgGlnAlaGluValIleAlaProAlaValGlnThrAsnTrp
  541    CTCCTGCAGACCGCGTCCCGTCAGGCAGAGGTTATCGCCCCTGCTGTCCAGACCAACTGG
         GAGGACGTCTGGCGCAGGGCAGTCCGTCTCCAATAGCGGGGACGACAGGTCTGGTTGACC GlnLysLeuGluThrPheTrpAlaLysHisMetTrpAsnPheIleSerGlyIleGlnTyr
  601    CAAAAACTCGAGACCTTCTGGGCGAAGCATATGTGGAACTTCATCAGTGGGATACAATAC
         GTTTTTGAGCTCTGGAAGACCCGCTTCGTATACACCTTGAAGTAGTCACCCTATGTTATG LeuAlaGlyLeuSerThrLeuProGlyAsnProAlaIleAlaSerLeuMetAlaPheThr
  661    TTGGCGGGCTTGTCAACGCTGCCTGGTAACCCCGCCATTGCTTCATTGATGGCTTTTACA
         AACCGCCCGAACAGTTGCGACGGACCATTGGGGCGGTAACGAAGTAACTACCGAAAATGT AlaAlaValThrSerProLeuThrThrSerGlnThrLeuLeuPheAsnIleLeuGlyGly
  721    GCTGCTGTCACCAGCCCACTAACCACTAGCCAAACCCTCCTCTTCAACATATTGGGGGGG
         CGACGACAGTGGTCGGGTGATTGGTGATCGGTTTGGGAGGAGAAGTTGTATAACCCCCCC TrpValAlaAlaGlnLeuAlaAlaProGlyAlaAlaThrAlaPheValGlyAlaGlyLeu
  781    TGGGTGGCTGCCCAGCTCGCCGCCCCCGGTGCCGCTACTGCCTTTGTGGGCGCTGGCTTA
         ACCCACCGACGGGTCGAGCGGCGGGGGCCACGGCGATGACGGAAACACCCGCGACCGAAT
```

FIG. 36B

```
        AlaGlyAlaAlaIleGlySerValGlyLeuGlyLysValLeuIleAspIleLeuAlaGly
 841    GCTGGCGCCGCCATCGGCAGTGTTGGACTGGGGAAGGTCCTCATAGACATCCTTGCAGGG
        CGACCGCGGCGGTAGCCGTCACAACCTGACCCCTTCCAGGAGTATCTGTAGGAACGTCCC

TyrGlyAlaGlyValAlaGlyAlaLeuValAlaPheLysIleMetSerGlyGluValPro
 901    TATGGCGCGGGCGTGGCGGGAGCTCTTGTGGCATTCAAGATCATGAGCGGTGAGGTCCCC
        ATACCGCGCCCGCACCGCCCTCGAGAACACCGTAAGTTCTAGTACTCGCCACTCCAGGGG

SerThrGluAspLeuValAsnLeuLeuProAlaIleLeuSerProGlyAlaLeuValVal
 961    TCCACGGAGGACCTGGTCAATCTACTGCCCGCCATCCTCTCGCCCGGAGCCCTCGTAGTC
        AGGTGCCTCCTGGACCAGTTAGATGACGGGCGGTAGGAGAGCGGGCCTCGGGAGCATCAG

GlyValValCysAlaAlaIleLeuArgArgHisValGlyProGlyGluGlyAlaValGln
1021    GGCGTGGTCTGTGCAGCAATACTGCGCCGGCACGTTGGCCCGGGCGAGGGGGCAGTGCAG
        CCGCACCAGACACGTCGTTATGACGCGGCCGTGCAACCGGGCCCGCTCCCCCGTCACGTC

<<<<<<<<<<<<<<<<<<<<<<NANBHJ[---extra
        TrpMetAsnArgLeuIleAlaPheAlaSerArgGlyAsnHisValSerProValHisHis
1081    TGGATGAACCGGCTGATAGCCTTCGCCTCCCGGGGGAACCATGTTTCCCCAGTCCATCAT
        ACCTACTTGGCCGACTATCGGAAGCGGAGGGCCCCCTTGGTACAAAGGGGTCAGGTAGTA -----]
        LysArgOP
1141    AAGCGTTGACGCTCCCTACGGGTGGACTGTGGAGAGACAGGGCACTGCTAAGGCCCAAAT
        TTCGCAACTGCGAGGGATGCCCACCTGACACCTCTCTGTCCCGTGACGATTCCGGGTTTA 1201    CTCAGCCATGCATCGAGGGGTACAATCCGTATGGCCAACAACTAGCGCGTACGTAAAGTC
        GAGTCGGTACGTAGCTCCCCATGTTAGGCATACCGGTTGTTGATCGCGCATGCATTTCAG 1261    TCCTTTCTCGATGGTCCATACCTTAGATGCGTTAGCATTAATCCGAATTC
        AGGAAAGAGCTACCAGGTATGGAATCTACGCAATCGTAATTAGGCTTAAG
```

FIG. 42A

```
              10        20        30        40        50
HCV      EYVVLLFLLLADARVCSCLWMMLLISQAEAALENLVILNAASLAGTHGLVSFLVFFCFA
MNWVD1   AVSFVTLITGNMSFRDLGRVMVMVGATMTDDIGMGVTYLALLAAFKVRPTFAAGLLLRKL
             130       140       150       160       170       180

60        70        80        90       100       110
HCV      WYLKGKWVPGAVYTFYGMWPLLLLLLALPQRAYALDTEVAASCGGVVLVGLMALTLSPYY
MNWVD1   TSKELMMTTIGIVLLSQSTIPETILELTDALALGMMVLKMVRKMEKYQLAVTIMAILCVP
             190       200       210       220       230       240

120       130       140       150       160       170
HCV      KRYISWCLWWLQYFLTRVEAQLHVWIPPLNVRGGRDAVILLMCAVHPTLVFDITKLLLAV
MNWVD1   NAVILQNAWKVSCTILAVVSVSPLFLTSSQQKADWIPLALTIKGLNPTAIF-LTTLSRTN
             250       260       270       280       290

180       190       200       210       220       230
HCV      FGPLWILQASLLKVPYF-VRVQGLLRF-CALARKMIGGHYVQMVIIKLGALTGTYVYNHL
MNWVD1   KKRSWPLNEAIMAVGMVSILASSLLKNDIPMTGPLVAGGLLTVCYV-LTGRSADLELERA
         300       310       320       330       340       350

240       250       260       270       280       290
HCV      TPLRDWAHNGLRDLAVAVEPVVFSQMETKLITWGADTAACGDIINGLPVSARRGREILLG
MNWVD1   ADVK-WEDQAEISGSSPILSITISE-DGSMSIKNEEEEQTLTILIRTGLLVISG---LFP
         360       370       380       390       400       410

300       310       320       330       340       350
HCV      PADGMVSKGWRLLAPITAYAQQTRGLLGCIITSLTGRDKNQVEGEVQIVSTAAQTFLATC
MNWVD1   VSIPITAAAWYLWEVKKQRAGVLWDVPSPPPVGKAELEDGAYRIKQKGILGYSQIGAGVY
         420       430       440       450       460       470

360       370       380       390       400       410
HCV      INGVCWTVYHGAGTRTIASPKGPVIQMYTNVDQDLV----GWPAPQGSRSLTPCTCGSSD
MNWVD1   KEGTFHTMWHVTRGAVLMHKGKRIEPSWADVKKDLVSCGGGWKLEGEWKEGEEVQVLALE
         480       490       500       510       520       530

420       430       440       450       460       470
HCV      LYLVTRHADVIPVRRRGDSRGSLLSPRPISYLKGSSGGPLLCPAGHAVGIFRAAVCTRGV
MNWVD1   PGKNPRAVQTKPGLFKTN--AGTIGAVSLDFSPGTSGSPIIDKKGKVVGLYGNGVVTRSG
         540       550       560       570       580       590
```

FIG. 42B

```
             480       490       500       510       520       530
HCV     AKAVDFIPVENLETTMRSPVFTDNSSPPVVPQSFQVAHLHAPTGSGKS--TKVPAAYAAQ
        .. ..: .:..:  .:::: :: :.. .    .: :.: . ...: .    .: . ::
MNWVD1  AYVSAIAQTEK--SIEDNPEIEDDIFRK---RKLTIMDLHPGAGKTKRYLPAIVRGAIKR
             600       610       620       630       640

540       550       560       570       580
HCV     GYKVLVLNPS--VAATLGFGAYMSKAHGIDPNIRTGVRTITTGSPITYSTYGKFLADGGC
        : ..: : ..   .  . . .  ..   .. : . .  :  :.:.  :.  . :  . .
MNWVD1  GLRTLILAPTRVVAAEMEEALRGLPIRYQTPAIRAEHTGREIVDLMCHATFTMRLL-SPV
             650       660       670       680       690       700

590       600       610       620       630       640
HCV     SGGAYDIIICDECHSTDATSILGIGTVLDQAETAGARLVVLATATPPGSVTVPHPNIEEV
        . . :. : X .:: :: :::  .   .      :. . .   :::::.   .  . V.
MNWVD1  RVPNYNLIIMDEAHFTDPASIAARGYISTRVE-MGEAAGIFMTATPPGSRD-PFPQSNAP
             710       720       730       740       750       760

650       660       670       680       690       700
HCV     ALSTTGEIPFYGKAIPLEVIKGGRHLIFCHSKKKCDELAAKLVALGINAVAYYRGLDVSV
        ...  . :: .                                                 
MNWVD1  IMDEEREIPERSWSSGHEWVTDFKGKTVWFVPSIKAGNDTAACLRKNGKKVTQLSRKTFD
             770       780       790       800       810       820

710       720       730       740       750       760
HCV     IPTSGDVVVVATDALMTGYTGDFDSVIDCNTCVTQTVDFSLDPTFTIETITLPQDAVSRT

MNWVD1  SEYVKTRTNDWNFVVTTDISEMGANFKAERVIDPRRCMKPVILTDGEERVILAGPMPVTH
             830       840       850       860       870       880

770       780       790       800       810       820
HCV     QRRGRTGRGKPGIYRFVAPGERPSGMFDSSVLCECYDAGCAWYELTPAETTVRLRAYMNT

MNWVD1  SS
```

FIG. 45

| Name | Common Sequence | Variable Sequence |
|---|---|---|
| 5'-3-1 | AAGCTTGATCGAATTC | CGATCTTGC |
| -2 | | CGATCCTGC |
| -3 | | CGATCATGC |
| -4 | | CGATCGTGC |
| -5 | | CGAAGTTGC |
| -6 | | CGAAGCTGC |
| -7 | | AGATCTTGC |
| -8 | | AGATCCTGC |
| -9 | | AGATCATGC |
| -10 | | AGATCGTGC |
| -11 | | AGAAGTTGC |
| -12 | | AGAAGCTGC |
| -13 | | CGATCTTGT |
| -14 | | CGATCCTGT |
| -15 | | CGATCATGT |
| -16 | | CGATCGTGT |
| -17 | | CGAAGTTGT |
| -18 | | CGAAGCTGT |
| -19 | | AGATCTTGT |
| -20 | | AGATCCTGT |
| -21 | | AGATCATGT |
| -22 | | AGATCGTGT |
| -23 | | AGAAGTTGT |
| -24 | | AGAAGCTGT |
| -25 | | CGCTCTTGC |
| -26 | | CGCTCCTGC |
| -27 | | CGCTCATGC |
| -28 | | CGCTCGTGC |
| -29 | | CGCAGTTGC |
| -30 | | CGCAGCTGC |
| -31 | | CGCTCTTGT |
| -32 | | CGCTCCTGT |
| -33 | | CGCTCATGT |
| -34 | | CGCTCGTGT |
| -35 | | CGCAGTTGT |
| -36 | | CGCAGCTGT |

FIG. 46A

```
     GlyCysProGluArgLeuAlaSerCysArgArgProLeuThrAspPheAspGlnGlyTrpGly
  1  CAGGCTGTCCTGAGAGGCTAGCCAGCTGCCGACCCCTTACCGATTTGACCAGGCTGGG
     GTCCGACAGGACTCTCCGATCGGTCGACGGCTGGGAATGGCTAAAACTGGTCCCGACCC

ProIleSerTyrAlaAsnGlyLysSerGlyProAspGlnArgProTyrCysTrpHisTyrPro
 61  GCCCTATCAGTTATGCCAACGGGAAGCGGCCCCGACCAGCGCCCCTACTGCTGGCACTACC
     CGGGATAGTCAATACGGTTGCCCTTCGCCGGGGCTGGTCGCGGGGGATGACGACCGTGATGG

ProLysProCysGlyIleValProAlaLysSerValCysGlyProValTyrCysPheThr
121  CCCCAAAACCTTGCGGTATTGTGCCCGCGAAGAGTGTGTGTCCGGTATATTGCTTCA
     GGGGTTTTGGAACGCCATAACACGGGCGCTTCTCACACACAGGCCATATAACGAAGT

ProSerProValValValGlyThrThrAspArgSerGlyAlaProThrTyrSerTrpGly
181  CTCCCAGCCCGTGGTGGGAACGACGACCAGTCGGGCGCCGCCACTACAGCTGGG
     GAGGGTCGGGCACCACCACCCTTGCTGCTGGTCAGCCGCGGCGGTGATGTCGACCC

GluAsnAspThrAspValPheValLeuAsnAsnThrArgProProLeuGlyAsnTrpPhe
241  GTGAAAATGATACGGACGTCTTCGTCCTTAACAATACCAGGCCACCGCTGGGCAATTGT
     CACTTTTACTATGCCTGCAGAAGCAGGAATTGTTATGGTCCGGTGGCGACCCGTTAACCA

GlyCysThrTrpMetAsnSerThrGlyPheThrLysValCysGlyAlaProProCysVal
301  TCGGTTGTACCTGTACTTGATGAACTCAACTGGATTCACCAAAGTGTGCGGAGCGCCTCTGTG
     AGCCAACATGGACCTACTTGAGTTGACCTAAGTTGACCTGTTTCACACGCCCTCGCGGAGGAACAC
```

FIG. 46B

```
       IleGlyAlaGlyAsnAsnThrLeuHisCysProThrAspCysPheArgLysHisPro
361 TCATCGAGGGGCGGGCAACAACACCCTGCACTGCCCCACTGATTGCTTCCGCAAGCATC
    AGTAGCCTCCCCGCCCGTTGTTGTGGACGTGACGGGGTGACTAACGAAGGCGTTCGTAG

AspAlaThrTyrSerArgCysSerGlyProTrpIleThrProArgCysLeuValAsp
421 CGGACGCCACATACTCTCGGTGCGGGCCTCCGGTCCCGGTCCCTGGATCACACCCAGGTCCTGGTCG
    GCCTGCGGTGTATGAGAGCCACGCCCGGAGGCCCAGGACCTAGTGTGGGTCCACGGACCAGC

TyrProTyrArgLeuTrpHisTyrProCysThrIleAsnTyrThrIlePheLysIleArg
481 ACTACCCGTATAGGCTTTGGCATTATCCTTGTACCATCAACTACACTATATTAAAATCA
    TGATGGGCATATCCGAAACCGTAATAGGAACATGGTAGTTGATGTGATATAAATTTTAGT

MetTyrValGlyGlyValGluHisArgLeuGluAlaAlaCysAsnTrpThrArgGlyGlu
541 GGATGTACGTGGGAGGGGTCGAGCAGGCTCGAAGCTGCCTGCAACTGACGCGGGGGCG
    CCTACATGCACCCTCCCCAGCTCGTCGTCCGAGCTTCGACGACGTTGACCTGCGCCCCGC

ArgCysAspLeuGluAspArgArgSerGluLeuSerProLeuLeuSerProLeuThrThr
601 AACGTTGCGATCTGGAAGATAGGAGCAGTCGAGCTCAGCCCCGTTACTGCTGACCACTA
    TTGCAACGCTAGACCTTCTATCCCTGTCCAGCTCGAGTCGGGCAATGACGACTGGTGAT

GlnTrpGlnValLeuProCysSerPheThrThrLeuProAlaLeuSerThrGlyLeuIle
661 CACAGTGGCCAGTCCCTCCAGGTCCTGTTCCTTCACAACCCTGCCAGCCTTGTCCACCGGCCTCA
    GTGTCACCGGTCAGGTCCAGGAGGGCACAAGGAAGTGTTGGGACGGTCGGAACAGGTGGCCGAGT
```

FIG. 46C

-----Overlap with Combined ORF of DNAs 12f through 15e-----

```
           HisLeuHisGlnAsnIleValAspValGlnTyrLeuTyrGlyValGlySerIleAla
721 TCCACCTCCACCAGAACATTGTGGACGTGCAGTACTTGTACGGGGTGGGTCAAGCATCG
    AGGTGGAGGTGGTCTTGTAACACCTGCACGTCATGAACATGCCCCACCCAGTTCGTAGC
```

```
    SerTrpAlaIleLysTrpGluTyrValValLeuLeuPheLeuLeuLeuAlaAspAlaArg
781 CGTCCTGGCCATTAAGTGGGAGTACGTCGTCCTCCTGTTCCTTCTGCTTGCAGACGCGC
    GCAGGACCGGTAATTCACCCTCATGCAGCAGGAGACAAGGAAGACGAACGTCTGCGCG
```

```
    ValCysSerCysLeuTrpMetMetLeuLeuIleSerGlnAlaGluAlaAlaAlaLeuGluAsn
841 GCGTCTGCTCCTGCTGGTGGATGATGCTACTCATATCCAAGCGGAAGCGGCTTTGGAGA
    CGCAGAGACGAGGACGAACACCTACTACGATGAGTATAGGGTTCGCCTTCGCCGAAACCTCT
```

```
    LeuValIleLeuAsnAlaAlaSerLeuAlaGlyThrHisGlyLeuValValSerPheLeuVal
901 ACCTCGTAATACTTAATGCAGCATCCCTGGCCGGGACGCACGGTCTTGTATCTTCCTCG
    TGGAGCATTATGAATTACGTCGTAGGGACCGGCCCTGCGTGCCAGAACATAGAAGGAGC
```

```
    PhePheCysPheAlaTrpTyrLeuLysGlyLysTrpValProGlyAlaValTyrThrPhe
961 TGTTCTTCTGCTTTGCATGGTATCTGAAGGGTAAGTGGGTGCCCGGAGCGGTCTACACCT
    ACAAGAAGACGAAACGTACCATAGACTTCCCATTCACCCACGGGCCTCGCCAGATGTGGA
```

FIG. 46D

```
                      TyrGlyMetTrpProLeuLeuLeuLeuLeuAlaLeuProGlnArgAlaTyrAlaLeu
1021 TCTACGGGATGTGGCCTCTCCTCCTGCTCCTGTTGGCGTTGCCCCAGCGCGGCGTACGCGC
     AGATGCCCTACACCGGAGAGGAGGACGAGGACAACCGCAACGGGGTCGCGCCCCATGGCG

AspThrGluValAlaAlaSerCysGlyGlyValValLeuValGlyLeuMetAlaLeuThr
1081 TGGACACGGAGGTGGCCGCGTCGTGTGGCGGTGTTGTTCTCTGGGTTGATGGCTAA
     ACCTGTGCCTCCACCGGCGCAGCACACCGCCACACAAGAGCAGCCCAACTACCGCGATT

LeuSerProTyrTyrTyrLysArgTyrIleSerTrpTrpCysLeuTrpTrpLeuGlnTyrPheLeu
1141 CTCTGTCACCATATTACAAGCGCTATATCAGCTGGTGGTGTTGTGGCTTGTGGCTTCAGTATTTC
     GAGACAGTGGTATATAATGTTCGCGATATAGTCGACCACGAACACCACGAAGTCATAAAAG

ThrArgValGluAlaGlnLeuLeuHisValTrpIleProProLeuAsnValArgGlyGlyArg
1201 TGACCAGAGTGGAAGCGCAACTGCTGCACGTGTGGATTCCCCCTCAAGTCCGAGGGGGC
     ACTGGTCTCACCTTCGCGTTGACGACGTGCACACCTAAGGGGGAGTTGCAGGCTCCCCCG

AspAlaValIleLeuLeuMetCysAlaValHisProThrLeuValPheAspIleThrLys
1261 GCGACGCTGTCATCTTACTCATGTGTGCTGTACACCCGACTCTGGTATTTGACATCACCA
     CGCTGCGACAGTAGAATGAGTACACACGACATGTGGGCTGAGACCATAAACTGTAGTGGT

LeuLeuLeuAlaValPheGlyProLeuTrpIleLeuGlnAla
1321 AATTGCTGCTGGCCGTCTTCGGACCCCTTTGGATTCTTCAAGCCAG
     TTAACGACGACCGGCAGAAGCCTGGGGAAACCTAAGAAGTTCGGTC
```

FIG. 47A

```
         GlyCysProGluArgLeuAlaSerCysArgProLeuThrAspPheAspGlnGlyTrpGly
  1   CAGGCTGTCCTGAGAGGCTAGCCAGCTGCCGACCCCTTACCGATTTTGACCAGGGCTGGG
        GTCCGACAGGACTCTCCGATCGGTCGACGGCTGGGGAATGGCTAAAACTGGTCCCGACCC

ProIleSerTyrAlaAsnGlySerGlyProAspGlnArgProTyrCysTrpHisTyrPro
 61   GCCCTATCAGTTATGCCAACGGAAGCGGCCCCGACCAGCGCCCCTACTGCTGGCACTACC
        CGGGATAGTCAATACGGTTGCCTTCGCCGGGGCTGGTCGCGGGGATGACGACCGTGATGG

ProLysProCysGlyIleValProAlaLysSerValCysGlyProValTyrCysPheThr
121   CCCCAAAACCTTGCGGTATTGTGCCCGCGAAGAGTGTGTGTGGTCCGGTATATTGCTTCA
        GGGGTTTTGGAACGCCATAACACGGGCGCTTCTCACACACACCAGGCCATATAACGAAGT

ProSerProValValValGlyThrThrAspArgSerGlyAlaProThrTyrSerTrpGly
181   CTCCCAGCCCCGTGGTGGTGGGAACGACCGACAGGTCGGGCGCGCCCACCTACAGCTGGG
        GAGGGTCGGGGCACCACCACCCTTGCTGGCTGTCCAGCCCGCGCGGGTGGATGTCGACCC

GluAsnAspThrAspValPheValLeuAsnAsnThrArgProProLeuGlyAsnTrpPhe
241   GTGAAAATGATACGGACGTCTTCGTCCTTAACAATACCAGGCCACCGCTGGGCAATTGGT
        CACTTTTACTATGCCTGCAGAAGCAGGAATTGTTATGGTCCGGTGGCGACCCGTTAACCA

GlyCysThrTrpMetAsnSerThrGlyPheThrLysValCysGlyAlaProProCysVal
301   TCGGTTGTACCTGGATGAACTCAACTGGATTCACCAAAGTGTGCGGAGCGCCTCCTTGTG
        AGCCAACATGGACCTACTTGAGTTGACCTAAGTGGTTTCACACGCCTCGCGGAGGAACAC

IleGlyGlyAlaGlyAsnAsnThrLeuHisCysProThrAspCysPheArgLysHisPro
361   TCATCGGAGGGCGGGCAACAACACCCTGCACTGCCCCACTGATTGCTTCCGCAAGCATC
        AGTAGCCTCCCCGCCCGTTGTTGTGGGACGTGACGGGGTGACTAACGAAGGCGTTCGTAG

AspAlaThrTyrSerArgCysGlySerGlyProTrpIleThrProArgCysLeuValAsp
421   CGGACGCCACATACTCTCGGTGCGGCTCCGGTCCCTGGATCACACCCAGGTGCCTGGTCG
        GCCTGCGGTGTATGAGAGCCACGCCGAGGCCAGGGACCTAGTGTGGGTCCACGGACCAGC

TyrProTyrArgLeuTrpHisTyrProCysThrIleAsnTyrThrIlePheLysIleArg
481   ACTACCCGTATAGGCTTTGGCATTATCCTTGTACCATCAACTACACCATATTTAAAATCA
        TGATGGGCATATCCGAAACCGTAATAGGAACATGGTAGTTGATGTGGTATAAATTTTAGT

MetTyrValGlyGlyValGluHisArgLeuGluAlaAlaCysAsnTrpThrArgGlyGlu
541   GGATGTACGTGGGAGGGGTCGAACACAGGCTGGAAGCTGCCTGCAACTGGACGCGGGGCG
        CCTACATGCACCCTCCCCAGCTTGTGTCCGACCTTCGACGGACGTTGACCTGCGCCCCGC

ArgCysAspLeuGluAspArgAspArgSerGluLeuSerProLeuLeuLeuThrThrThr
601   AACGTTGCGATCTGGAAGACAGGGACAGGTCCGAGCTCAGCCCGTTACTGCTGACCACTA
        TTGCAACGCTAGACCTTCTGTCCCTGTCCAGGCTCGAGTCGGGCAATGACGACTGGTGAT

GlnTrpGlnValLeuProCysSerPheThrThrLeuProAlaLeuSerThrGlyLeuIle
661   CACAGTGGCAGGTCCTCCCGTGTTCCTTCACAACCCTACCAGCCTTGTCCACCGGCCTCA
        GTGTCACCGTCCAGGAGGGCACAAGGAAGTGTTGGGATGGTCGGAACAGGTGGCCGGAGT

HisLeuHisGlnAsnIleValAspValGlnTyrLeuTyrGlyValGlySerSerIleAla
721   TCCACCTCCACCAGAACATTGTGGACGTGCAGTACTTGTACGGGGTGGGGTCAAGCATCG
        AGGTGGAGGTGGTCTTGTAACACCTGCACGTCATGAACATGCCCCACCCCAGTTCGTAGC

SerTrpAlaIleLysTrpGluTyrValValLeuLeuPheLeuLeuLeuAlaAspAlaArg
781   CGTCCTGGGCCATTAAGTGGGAGTACGTCGTTCTCCTGTTCCTTCTGCTTGCAGACGCGC
        GCAGGACCCGGTAATTCACCCTCATGCAGCAAGAGGACAAGGAAGACGAACGTCTGCGCG

ValCysSerCysLeuTrpMetMetLeuLeuIleSerGlnAlaGluAlaAlaLeuGluAsn
841   GCGTCTGCTCCTGCTTGTGGATGATGCTACTCATATCCCAAGCGGAGGCGGCTTTGGAGA
        CGCAGACGAGGACGAACACCTACTACGATGAGTATAGGGTTCGCCTCCGCCGAAACCTCT

LeuValIleLeuAsnAlaAlaSerLeuAlaGlyThrHisGlyLeuValSerPheLeuVal
901   ACCTCGTAATACTTAATGCAGCATCCCTGGCCGGGACGCACGGTCTTGTATCCTTCCTCG
        TGGAGCATTATGAATTACGTCGTAGGGACCGGCCCTGCGTGCCAGAACATAGGAAGGAGC
```

FIG. 47B

```
       PhePheCysPheAlaTrpTyrLeuLysGlyLysTrpValProGlyAlaValTyrThrPhe
 961 TGTTCTTCTGCTTTGCATGGTATTTGAAGGGTAAGTGGGTGCCCGGAGCGGTCTACACCT
     ACAAGAAGACGAAACGTACCATAAACTTCCCATTCACCCACGGGCCTCGCCAGATGTGGA

TyrGlyMetTrpProLeuLeuLeuLeuLeuAlaLeuProGlnArgAlaTyrAlaLeu
1021 TCTACGGGATGTGGCCTCTCCTCCTGCTCCTGTTGGCGTTGCCCCAGCGGGCGTACGCGC
     AGATGCCCTACACCGGAGAGGAGGACGAGGACAACCGCAACGGGGTCGCCCGCATGCGCG

AspThrGluValAlaAlaSerCysGlyGlyValValLeuValGlyLeuMetAlaLeuThr
1081 TGGACACGGAGGTGGCCGCGTCGTGTGGCGGTGTTGTTCTCGTCGGGTTGATGGCGCTGA
     ACCTGTGCCTCCACCGGCGCAGCACACCGCCACAACAAGAGCAGCCCAACTACCGCGACT

LeuSerProTyrTyrLysArgTyrIleSerTrpCysLeuTrpTrpLeuGlnTyrPheLeu
1141 CTCTGTCACCATATTACAAGCGCTATATCAGCTGGTGCTTGTGGTGGCTTCAGTATTTTC
     GAGACAGTGGTATAATGTTCGCGATATAGTCGACCACGAACACCACCGAAGTCATAAAAG

ThrArgValGluAlaGlnLeuHisValTrpIleProProLeuAsnValArgGlyGlyArg
1201 TGACCAGAGTGGAAGCGCAACTGCACGTGTGGATTCCCCCCCTCAACGTCCGAGGGGGGC
     ACTGGTCTCACCTTCGCGTTGACGTGCACACCTAAGGGGGGGAGTTGCAGGCTCCCCCCG

AspAlaValIleLeuLeuMetCysAlaValHisProThrLeuValPheAspIleThrLys
1261 GCGACGCCGTCATCTTACTCATGTGTGCTGTACACCCGACTCTGGTATTTGACATCACCA
     CGCTGCGGCAGTAGAATGAGTACACACGACATGTGGGCTGAGACCATAAACTGTAGTGGT

LeuLeuLeuAlaValPheGlyProLeuTrpIleLeuGlnAlaSerLeuLeuLysValPro
1321 AATTGCTGCTGGCCGTCTTCGGACCCCTTTGGATTCTTCAAGCCAGTTTGCTTAAAGTAC
     TTAACGACGACCGGCAGAAGCCTGGGGAAACCTAAGAAGTTCGGTCAAACGAATTTCATG

TyrPheValArgValGlnGlyLeuLeuArgPheCysAlaLeuAlaArgLysMetIleGly
1381 CCTACTTTGTGCGCGTCCAAGGCCTTCTCCGGTTCTGCGCGTTAGCGCGGAAGATGATCG
     GGATGAAACACGCGCAGGTTCCGGAAGAGGCCAAGACGCGCAATCGCGCCTTCTACTAGC

GlyHisTyrValGlnMetValIleIleLysLeuGlyAlaLeuThrGlyThrTyrValTyr
1441 GAGGCCATTACGTGCAAATGGTCATCATTAAGTTAGGGGCGCTTACTGGCACCTATGTTT
     CTCCGGTAATGCACGTTTACCAGTAGTAATTCAATCCCCGCGAATGACCGTGGATACAAA

AsnHisLeuThrProLeuArgAspTrpAlaHisAsnGlyLeuArgAspLeuAlaValAla
1501 ATAACCATCTCACTCCTCTTCGGGACTGGGCGCACAACGGCTTGCGAGATCTGGCCGTGG
     TATTGGTAGAGTGAGGAGAAGCCCTGACCCGCGTGTTGCCGAACGCTCTAGACCGGCACC

ValGluProValValPheSerGlnMetGluThrLysLeuIleThrTrpGlyAlaAspThr
1561 CTGTAGAGCCAGTCGTCTTCTCCCAAATGGAGACCAAGCTCATCACGTGGGGGGCAGATA
     GACATCTCGGTCAGCAGAAGAGGGTTTACCTCTGGTTCGAGTAGTGCACCCCCCGTCTAT

AlaAlaCysGlyAspIleIleAsnGlyLeuProValSerAlaArgArgGlyArgGluIle
1621 CCGCCGCGTGCGGTGACATCATCAACGGCTTGCCTGTTTCCGCCCGCAGGGGCCGGGAGA
     GGCGGCGCACGCCACTGTAGTAGTTGCCGAACGGACAAAGGCGGGCGTCCCCGGCCCTCT

LeuLeuGlyProAlaAspGlyMetValSerLysGlyTrpArgLeuLeuAlaProIleThr
1681 TACTGCTCGGGCCAGCCGATGGAATGGTCTCCAAGGGGTGGAGGTTGCTGGCGCCCATCA
     ATGACGAGCCCGGTCGGCTACCTTACCAGAGGTTCCCCACCTCCAACGACCGCGGGTAGT

AlaTyrAlaGlnGlnThrArgGlyLeuLeuGlyCysIleIleThrSerLeuThrGlyArg
1741 CGGCGTACGCCCAGCAGACAAGGGGCCTCCTAGGGTGCATAATCACCAGCCTAACTGGCC
     GCCGCATGCGGGTCGTCTGTTCCCCGGAGGATCCCACGTATTAGTGGTCGGATTGACCGG

AspLysAsnGlnValGluGlyGluValGlnIleValSerThrAlaAlaGlnThrPheLeu
1801 GGGACAAAAACCAAGTGGAGGGTGAGGTCCAGATTGTGTCAACTGCTGCCCAAACCTTCC
     CCCTGTTTTTGGTTCACCTCCCACTCCAGGTCTAACACAGTTGACGACGGGTTTGGAAGG

AlaThrCysIleAsnGlyValCysTrpThrValTyrHisGlyAlaGlyThrArgThrIle
1861 TGGCAACGTGCATCAATGGGGTGTGCTGGACTGTCTACCACGGGGCCGGAACGAGGACCA
     ACCGTTGCACGTAGTTACCCCACACGACCTGACAGATGGTGCCCCGGCCTTGCTCCTGGT

AlaSerProLysGlyProValIleGlnMetTyrThrAsnValAspGlnAspLeuValGly
1921 TCGCGTCACCCAAGGGTCCTGTCATCCAGATGTATACCAATGTAGACCAAGACCTTGTGG
     AGCGCAGTGGGTTCCCAGGACAGTAGGTCTACATATGGTTACATCTGGTTCTGGAACACC
```

FIG. 47C

```
     TrpProAlaProGlnGlySerArgSerLeuThrProCysThrCysGlySerSerAspLeu
1981 GCTGGCCCGCTCCGCAAGGTAGCCGCTCATTGACACCCTGCACTTGCGGCTCCTCGGACC
     CGACCGGGCGAGGCGTTCCATCGGCGAGTAACTGTGGGACGTGAACGCCGAGGAGCCTGG

TyrLeuValThrArgHisAlaAspValIleProValArgArgArgGlyAspSerArgGly
2041 TTTACCTGGTCACGAGGCACGCCGATGTCATTCCCGTGCGCCGGCGGGGTGATAGCAGGG
     AAATGGACCAGTGCTCCGTGCGGCTACAGTAAGGGCACGCGGCCGCCCCACTATCGTCCC

SerLeuLeuSerProArgProIleSerTyrLeuLysGlySerSerGlyGlyProLeuLeu
2101 GCAGCCTGCTGTCGCCCCGGCCCATTTCCTACTTGAAAGGCTCCTCGGGGGGTCCGCTGT
     CGTCGGACGACAGCGGGGCCGGGTAAAGGATGAACTTTCCGAGGAGCCCCCCAGGCGACA

CysProAlaGlyHisAlaValGlyIlePheArgAlaAlaValCysThrArgGlyValAla
2161 TGTGCCCCGCGGGGCACGCCGTGGGCATATTTAGGGCCGCGGTGTGCACCCGTGGAGTGG
     ACACGGGGCGCCCCGTGCGGCACCCGTATAAATCCCGGCGCCACACGTGGGCACCTCACC

LysAlaValAspPheIleProValGluAsnLeuGluThrThrMetArgSerProValPhe
2221 CTAAGGCGGTGGACTTTATCCCTGTGGAGAACCTAGAGACAACCATGAGGTCCCCGGTGT
     GATTCCGCCACCTGAAATAGGGACACCTCTTGGATCTCTGTTGGTACTCCAGGGGCCACA

ThrAspAsnSerSerProProValValProGlnSerPheGlnValAlaHisLeuHisAla
2281 TCACGGATAACTCCTCTCCACCAGTAGTGCCCCAGAGCTTCCAGGTGGCTCACCTCCATG
     AGTGCCTATTGAGGAGAGGTGGTCATCACGGGGTCTCGAAGGTCCACCGAGTGGAGGTAC

ProThrGlySerGlyLysSerThrLysValProAlaAlaTyrAlaAlaGlnGlyTyrLys
2341 CTCCCACAGGCAGCGGCAAAAGCACCAAGGTCCCGGCTGCATATGCAGCTCAGGGCTATA
     GAGGGTGTCCGTCGCCGTTTTCGTGGTTCCAGGGCCGACGTATACGTCGAGTCCCGATAT

ValLeuValLeuAsnProSerValAlaAlaThrLeuGlyPheGlyAlaTyrMetSerLys
2401 AGGTGCTAGTACTCAACCCCTCTGTTGCTGCAACACTGGGCTTTGGTGCTTACATGTCCA
     TCCACGATCATGAGTTGGGGAGACAACGACGTTGTGACCCGAAACCACGAATGTACAGGT

AlaHisGlyIleAspProAsnIleArgThrGlyValArgThrIleThrThrGlySerPro
2461 AGGCTCATGGGATCGATCCTAACATCAGGACCGGGGTGAGAACAATTACCACTGGCAGCC
     TCCGAGTACCCTAGCTAGGATTGTAGTCCTGGCCCCACTCTTGTTAATGGTGACCGTCGG

IleThrTyrSerThrTyrGlyLysPheLeuAlaAspGlyGlyCysSerGlyGlyAlaTyr
2521 CCATCACGTACTCCACCTACGGCAAGTTCCTTGCCGACGGCGGGTGCTCGGGGGGCGCTT
     GGTAGTGCATGAGGTGGATGCCGTTCAAGGAACGGCTGCCGCCCACGAGCCCCCCGCGAA

AspIleIleIleCysAspGluCysHisSerThrAspAlaThrSerIleLeuGlyIleGly
2581 ATGACATAATAATTTGTGACGAGTGCCACTCCACGGATGCCACATCCATCTTGGGCATCG
     TACTGTATTATTAAACACTGCTCACGGTGAGGTGCCTACGGTGTAGGTAGAACCCGTAGC

ThrValLeuAspGlnAlaGluThrAlaGlyAlaArgLeuValValLeuAlaThrAlaThr
2641 GCACTGTCCTTGACCAAGCAGAGACTGCGGGGGCGAGACTGGTTGTGCTCGCCACCGCCA
     CGTGACAGGAACTGGTTCGTCTCTGACGCCCCCGCTCTGACCAACACGAGCGGTGGCGGT

ProProGlySerValThrValProHisProAsnIleGluGluValAlaLeuSerThrThr
2701 CCCCTCCGGGCTCCGTCACTGTGCCCCATCCCAACATCGAGGAGGTTGCTCTGTCCACCA
     GGGGAGGCCCGAGGCAGTGACACGGGGTAGGGTTGTAGCTCCTCCAACGAGACAGGTGGT

GlyGluIleProPheTyrGlyLysAlaIleProLeuGluValIleLysGlyGlyArgHis
2761 CCGGAGAGATCCCTTTTTACGGCAAGGCTATCCCCCTCGAAGTAATCAAGGGGGGAGAC
     GGCCTCTCTAGGGAAAAATGCCGTTCCGATAGGGGGAGCTTCATTAGTTCCCCCCCTCTG

LeuIlePheCysHisSerLysLysLysCysAspGluLeuAlaAlaLysLeuValAlaLeu
2821 ATCTCATCTTCTGTCATTCAAAGAAGAAGTGCGACGAACTCGCCGCAAAGCTGGTCGCAT
     TAGAGTAGAAGACAGTAAGTTTCTTCTTCACGCTGCTTGAGCGGCGTTTCGACCAGCGTA

GlyIleAsnAlaValAlaTyrTyrArgGlyLeuAspValSerValIleProThrSerGly
2881 TGGGCATCAATGCCGTGGCCTACTACCGCGGTCTTGACGTGTCCGTCATCCCGACCAGCG
     ACCCGTAGTTACGGCACCGGATGATGGCGCCAGAACTGCACAGGCAGTAGGGCTGGTCGC

AspValValValValAlaThrAspAlaLeuMetThrGlyTyrThrGlyAspPheAspSer
2941 GCGATGTTGTCGTCGTGGCAACCGATGCCCTCATGACCGGCTATACCGGCGACTTCGACT
     CGCTACAACAGCAGCACCGTTGGCTACGGGAGTACTGGCCGATATGGCCGCTGAAGCTGA
```

FIG. 47D

```
         ValIleAspCysAsnThrCysValThrGlnThrValAspPheSerLeuAspProThrPhe
3001 CGGTGATAGACTGCAATACGTGTGTCACCCAGACAGTCGATTTCAGCCTTGACCCTACCT
     GCCACTATCTGACGTTATGCACACAGTGGGTCTGTCAGCTAAAGTCGGAACTGGGATGGA

ThrIleGluThrIleThrLeuProGlnAspAlaValSerArgThrGlnArgArgGlyArg
3061 TCACCATTGAGACAATCACGCTCCCCCAGGATGCTGTCTCCCGCACTCAACGTCGGGGCA
     AGTGGTAACTCTGTTAGTGCGAGGGGGTCCTACGACAGAGGGCGTGAGTTGCAGCCCCGT

ThrGlyArgGlyLysProGlyIleTyrArgPheValAlaProGlyGluArgProSerGly
3121 GGACTGGCAGGGGGAAGCCAGGCATCTACAGATTTGTGGCACCGGGGGAGCGCCCCTCCG
     CCTGACCGTCCCCCTTCGGTCCGTAGATGTCTAAACACCGTGGCCCCCTCGCGGGGAGGC

MetPheAspSerSerValLeuCysGluCysTyrAspAlaGlyCysAlaTrpTyrGluLeu
3181 GCATGTTCGACTCGTCCGTCCTCTGTGAGTGCTATGACGCAGGCTGTGCTTGGTATGAGC
     CGTACAAGCTGAGCAGGCAGGAGACACTCACGATACTGCGTCCGACACGAACCATACTCG

ThrProAlaGluThrThrValArgLeuArgAlaTyrMetAsnThrProGlyLeuProVal
3241 TCACGCCCGCCGAGACTACAGTTAGGCTACGAGCGTACATGAACACCCCGGGGCTTCCCG
     AGTGCGGGCGGCTCTGATGTCAATCCGATGCTCGCATGTACTTGTGGGGCCCCGAAGGGC

CysGlnAspHisLeuGluPheTrpGluGlyValPheThrGlyLeuThrHisIleAspAla
3301 TGTGCCAGGACCATCTTGAATTTTGGGAGGGCGTCTTTACAGGCCTCACTCATATAGATG
     ACACGGTCCTGGTAGAACTTAAAACCCTCCCGCAGAAATGTCCGGAGTGAGTATATCTAC

HisPheLeuSerGlnThrLysGlnSerGlyGluAsnLeuProTyrLeuValAlaTyrGln
3361 CCCACTTTCTATCCCAGACAAAGCAGAGTGGGGAGAACCTTCCTTACCTGGTAGCGTACC
     GGGTGAAAGATAGGGTCTGTTTCGTCTCACCCCTCTTGGAAGGAATGGACCATCGCATGG

AlaThrValCysAlaArgAlaGlnAlaProProProSerTrpAspGlnMetTrpLysCys
3421 AAGCCACCGTGTGCGCTAGGGCTCAAGCCCCTCCCCCATCGTGGGACCAGATGTGGAAGT
     TTCGGTGGCACACGCGATCCCGAGTTCGGGGAGGGGGTAGCACCCTGGTCTACACCTTCA

LeuIleArgLeuLysProThrLeuHisGlyProThrProLeuLeuTyrArgLeuGlyAla
3481 GTTTGATTCGCCTCAAGCCCACCCTCCATGGGCCAACACCCCTGCTATACAGACTGGGCG
     CAAACTAAGCGGAGTTCGGGTGGGAGGTACCCGGTTGTGGGGACGATATGTCTGACCCGC

ValGlnAsnGluIleThrLeuThrHisProValThrLysTyrIleMetThrCysMetSer
3541 CTGTTCAGAATGAAATCACCCTGACGCACCCAGTCACCAAATACATCATGACATGCATGT
     GACAAGTCTTACTTTAGTGGGACTGCGTGGGTCAGTGGTTTATGTAGTACTGTACGTACA

AlaAspLeuGluValValThrSerThrTrpValLeuValGlyGlyValLeuAlaAlaLeu
3601 CGGCCGACCTGGAGGTCGTCACGAGCACCTGGGTGCTCGTTGGCGGCGTCCTGGCTGCTT
     GCCGGCTGGACCTCCAGCAGTGCTCGTGGACCCACGAGCAACCGCCGCAGGACCGACGAA

AlaAlaTyrCysLeuSerThrGlyCysValValIleValGlyArgValValLeuSerGly
3661 TGGCCGCGTATTGCCTGTCAACAGGCTGCGTGGTCATAGTGGGCAGGGTCGTCTTGTCCG
     ACCGGCGCATAACGGACAGTTGTCCGACGCACCAGTATCACCCGTCCCAGCAGAACAGGC

LysProAlaIleIleProAspArgGluValLeuTyrArgGluPheAspGluMetGluGlu
3721 GGAAGCCGGCAATCATACCTGACAGGGAAGTCCTCTACCGAGAGTTCGATGAGATGGAAG
     CCTTCGGCCGTTAGTATGGACTGTCCCTTCAGGAGATGGCTCTCAAGCTACTCTACCTTC

CysSerGlnHisLeuProTyrIleGluGlnGlyMetMetLeuAlaGluGlnPheLysGln
3781 AGTGCTCTCAGCACTTACCGTACATCGAGCAAGGGATGATGCTCGCCGAGCAGTTCAAGC
     TCACGAGAGTCGTGAATGGCATGTAGCTCGTTCCCTACTACGAGCGGCTCGTCAAGTTCG

LysAlaLeuGlyLeuLeuGlnThrAlaSerArgGlnAlaGluValIleAlaProAlaVal
3841 AGAAGGCCCTCGGCCTCCTGCAGACCGCGTCCCGTCAGGCAGAGGTTATCGCCCCTGCTG
     TCTTCCGGGAGCCGGAGGACGTCTGGCGCAGGGCAGTCCGTCTCCAATAGCGGGGACGAC

GlnThrAsnTrpGlnLysLeuGluThrPheTrpAlaLysHisMetTrpAsnPheIleSer
3901 TCCAGACCAACTGGCAAAAACTCGAGACCTTCTGGGCGAAGCATATGTGGAACTTCATCA
     AGGTCTGGTTGACCGTTTTTGAGCTCTGGAAGACCCGCTTCGTATACACCTTGAAGTAGT

GlyIleGlnTyrLeuAlaGlyLeuSerThrLeuProGlyAsnProAlaIleAlaSerLeu
3961 GTGGGATACAATACTTGGCGGGCTTGTCAACGCTGCCTGGTAACCCCGCCATTGCTTCAT
     CACCCTATGTTATGAACCGCCCGAACAGTTGCGACGGACCATTGGGGCGGTAACGAAGTA
```

FIG. 47E

```
           MetAlaPheThrAlaAlaValThrSerProLeuThrThrSerGlnThrLeuLeuPheAsn
4021 TGATGGCTTTTACAGCTGCTGTCACCAGCCCACTAACCACTAGCCAAACCCTCCTCTTCA
     ACTACCGAAAATGTCGACGACAGTGGTCGGGTGATTGGTGATCGGTTTGGGAGGAGAAGT

IleLeuGlyGlyTrpValAlaAlaGlnLeuAlaAlaProGlyAlaAlaThrAlaPheVal
4081 ACATATTGGGGGGGTGGGTGGCTGCCCAGCTCGCCGCCCCGGTGCCGCTACTGCCTTTG
     TGTATAACCCCCCCACCCACCGACGGGTCGAGCGGCGGGGGCCACGGCGATGACGGAAAC

GlyAlaGlyLeuAlaGlyAlaAlaIleGlySerValGlyLeuGlyLysValLeuIleAsp
4141 TGGGCGCTGGCTTAGCTGGCGCCGCCATCGGCAGTGTTGGACTGGGGAAGGTCCTCATAG
     ACCCGCGACCGAATCGACCGCGGCGGTAGCCGTCACAACCTGACCCCTTCCAGGAGTATC

IleLeuAlaGlyTyrGlyAlaGlyValAlaGlyAlaLeuValAlaPheLysIleMetSer
4201 ACATCCTTGCAGGGTATGGCGCGGGCGTGGCGGGAGCTCTTGTGGCATTCAAGATCATGA
     TGTAGGAACGTCCCATACCGCGCCCGCACCGCCCTCGAGAACACCGTAAGTTCTAGTACT

GlyGluValProSerThrGluAspLeuValAsnLeuLeuProAlaIleLeuSerProGly
4261 GCGGTGAGGTCCCCTCCACGGAGGACCTGGTCAATCTACTGCCCGCCATCCTCTCGCCCG
     CGCCACTCCAGGGGAGGTGCCTCCTGGACCAGTTAGATGACGGGCGGTAGGAGAGCGGGC

AlaLeuValValGlyValValCysAlaAlaIleLeuArgArgHisValGlyProGlyGlu
4321 GAGCCCTCGTAGTCGGCGTGGTCTGTGCAGCAATACTGCGCCGGCACGTTGGCCCGGGCG
     CTCGGGAGCATCAGCCGCACCAGACACGTCGTTATGACGCGGCCGTGCAACCGGGCCCGC

GlyAlaValGlnTrpMetAsnArgLeuIleAlaPheAlaSerArgGlyAsnHisValSer
4381 AGGGGGCAGTGCAGTGGATGAACCGGCTGATAGCCTTCGCCTCCCGGGGGAACCATGTTT
     TCCCCCGTCACGTCACCTACTTGGCCGACTATCGGAAGCGGAGGGCCCCCTTGGTACAAA

ProThrHisTyrValProGluSerAspAlaAlaAlaArgValThrAlaIleLeuSerSer
4441 CCCCCACGCACTACGTGCCGGAGAGCGATGCAGCTGCCCGCGTCACTGCCATACTCAGCA
     GGGGGTGCGTGATGCACGGCCTCTCGCTACGTCGACGGGCGCAGTGACGGTATGAGTCGT

LeuThrValThrGlnLeuLeuArgArgLeuHisGlnTrpIleSerSerGluCysThrThr
4501 GCCTCACTGTAACCCAGCTCCTGAGGCGACTGCACCAGTGGATAAGCTCGGAGTGTACCA
     CGGAGTGACATTGGGTCGAGGACTCCGCTGACGTGGTCACCTATTCGAGCCTCACATGGT

ProCysSerGlySerTrpLeuArgAspIleTrpAspTrpIleCysGluValLeuSerAsp
4561 CTCCATGCTCCGGTTCCTGGCTAAGGGACATCTGGGACTGGATATGCGAGGTGTTGAGCG
     GAGGTACGAGGCCAAGGACCGATTCCCTGTAGACCCTGACCTATACGCTCCACAACTCGC

PheLysThrTrpLeuLysAlaLysLeuMetProGlnLeuProGlyIleProPheValSer
4621 ACTTTAAGACCTGGCTAAAAGCTAAGCTCATGCCACAGCTGCCTGGGATCCCCTTTGTGT
     TGAAATTCTGGACCGATTTTCGATTCGAGTACGGTGTCGACGGACCCTAGGGGAAACACA

CysGlnArgGlyTyrLysGlyValTrpArgValAspGlyIleMetHisThrArgCysHis
4681 CCTGCCAGCGCGGGTATAAGGGGGTCTGGCGAGTGGACGGCATCATGCACACTCGCTGCC
     GGACGGTCGCGCCCATATTCCCCCAGACCGCTCACCTGCCGTAGTACGTGTGAGCGACGG

CysGlyAlaGluIleThrGlyHisValLysAsnGlyThrMetArgIleValGlyProArg
4741 ACTGTGGAGCTGAGATCACTGGACATGTCAAAAACGGGACGATGAGGATCGTCGGTCCTA
     TGACACCTCGACTCTAGTGACCTGTACAGTTTTTGCCCTGCTACTCCTAGCAGCCAGGAT

ThrCysArgAsnMetTrpSerGlyThrPheProIleAsnAlaTyrThrThrGlyProCys
4801 GGACCTGCAGGAACATGTGGAGTGGGACCTTCCCCATTAATGCCTACACCACGGGCCCCT
     CCTGGACGTCCTTGTACACCTCACCCTGGAAGGGGTAATTACGGATGTGGTGCCCGGGGA

ThrProLeuProAlaProAsnTyrThrPheAlaLeuTrpArgValSerAlaGluGluTyr
4861 GTACCCCCCTTCCTGCGCCGAACTACACGTTCGCGCTATGGAGGGTGTCTGCAGAGGAAT
     CATGGGGGGAAGGACGCGGCTTGATGTGCAAGCGCGATACCTCCCACAGACGTCTCCTTA

ValGluIleArgGlnValGlyAspPheHisTyrValThrGlyMetThrThrAspAsnLeu
4921 ATGTGGAGATAAGGCAGGTGGGGGACTTCCACTACGTGACGGGTATGACTACTGACAATC
     TACACCTCTATTCCGTCCACCCCCTGAAGGTGATGCACTGCCCATACTGATGACTGTTAG

LysCysProCysGlnValProSerProGluPhePheThrGluLeuAspGlyValArgLeu
4981 TCAAATGCCCGTGCCAGGTCCCATCGCCCGAATTTTTCACAGAATTGGACGGGGTGCGCC
     AGTTTACGGGCACGGTCCAGGGTAGCGGGCTTAAAAAGTGTCTTAACCTGCCCCACGCGG
```

FIG. 47F

```
              HisArgPheAlaProProCysLysProLeuLeuArgGluGluValSerPheArgValGly
5041 TACATAGGTTTGCGCCCCCTGCAAGCCCTTGCTGCGGGAGGAGGTATCATTCAGAGTAG
     ATGTATCCAAACGCGGGGGGACGTTCGGGAACGACGCCCTCCTCCATAGTAAGTCTCATC

LeuHisGluTyrProValGlySerGlnLeuProCysGluProGluProAspValAlaVal
5101 GACTCCACGAATACCCGGTAGGGTCGCAATTACCTTGCGAGCCCGAACCGGACGTGGCCG
     CTGAGGTGCTTATGGGCCATCCCAGCGTTAATGGAACGCTCGGGCTTGGCCTGCACCGGC

LeuThrSerMetLeuThrAspProSerHisIleThrAlaGluAlaAlaGlyArgArgLeu
5161 TGTTGACGTCCATGCTCACTGATCCCTCCCATATAACAGCAGAGGCGGCCGGGCGAAGGT
     ACAACTGCAGGTACGAGTGACTAGGGAGGGTATATTGTCGTCTCCGCCGGCCCGCTTCCA

AlaArgGlySerProProSerValAlaSerSerSerAlaSerGlnLeuSerAlaProSer
5221 TGGCGAGGGGATCACCCCCCTCTGTGGCCAGCTCCTCGGCTAGCCAGCTATCCGCTCCAT
     ACCGCTCCCCTAGTGGGGGGAGACACCGGTCGAGGAGCCGATCGGTCGATAGGCGAGGTA

LeuLysAlaThrCysThrAlaAsnHisAspSerProAspAlaGluLeuIleGluAlaAsn
5281 CTCTCAAGGCAACTTGCACCGCTAACCATGACTCCCCTGATGCTGAGCTCATAGAGGCCA
     GAGAGTTCCGTTGAACGTGGCGATTGGTACTGAGGGGACTACGACTCGAGTATCTCCGGT

LeuLeuTrpArgGlnGluMetGlyGlyAsnIleThrArgValGluSerGluAsnLysVal
5341 ACCTCCTATGGAGGCAGGAGATGGGCGGCAACATCACCAGGGTTGAGTCAGAAAACAAAG
     TGGAGGATACCTCCGTCCTCTACCCGCCGTTGTAGTGGTCCCAACTCAGTCTTTTGTTTC

ValIleLeuAspSerPheAspProLeuValAlaGluGluAspGluArgGluIleSerVal
5401 TGGTGATTCTGGACTCCTTCGATCCGCTTGTGGCGGAGGAGGACGAGCGGGAGATCTCCG
     ACCACTAAGACCTGAGGAAGCTAGGCGAACACCGCCTCCTCCTGCTCGCCCTCTAGAGGC

ProAlaGluIleLeuArgLysSerArgArgPheAlaGlnAlaLeuProValTrpAlaArg
5461 TACCCGCAGAAATCCTGCGGAAGTCTCGGAGATTCGCCCAGGCCCTGCCCGTTTGGGCGC
     ATGGGCGTCTTTAGGACGCCTTCAGAGCCTCTAAGCGGGTCCGGGACGGGCAAACCCGCG

ProAspTyrAsnProProLeuValGluThrTrpLysLysProAspTyrGluProProVal
5521 GGCCGGACTATAACCCCCCGCTAGTGGAGACGTGGAAAAAGCCCGACTACGAACCACCTG
     CCGGCCTGATATTGGGGGGCGATCACCTCTGCACCTTTTTCGGGCTGATGCTTGGTGGAC

ValHisGlyCysProLeuProProProLysSerProProValProProProArgLysLys
5581 TGGTCCATGGCTGTCCGCTTCCACCTCCAAAGTCCCCTCCTGTGCCTCCGCCTCGGAAGA
     ACCAGGTACCGACAGGCGAAGGTGGAGGTTTCAGGGGAGGACACGGAGGCGGAGCCTTCT

ArgThrValValLeuThrGluSerThrLeuSerThrAlaLeuAlaGluLeuAlaThrArg
5641 AGCGGACGGTGGTCCTCACTGAATCAACCCTATCTACTGCCTTGGCCGAGCTCGCCACCA
     TCGCCTGCCACCAGGAGTGACTTAGTTGGGATAGATGACGGAACCGGCTCGAGCGGTGGT

SerPheGlySerSerSerThrSerGlyIleThrGlyAspAsnThrThrThrSerSerGlu
5701 GAAGCTTTGGCAGCTCCTCAACTTCCGGCATTACGGGCGACAATACGACAACATCCTCTG
     CTTCGAAACCGTCGAGGAGTTGAAGGCCGTAATGCCCGCTGTTATGCTGTTGTAGGAGAC

ProAlaProSerGlyCysProProAspSerAspAlaGluSerTyrSerSerMetProPro
5761 AGCCCGCCCCTTCTGGCTGCCCCCCCGACTCCGACGCTGAGTCCTATTCCTCCATGCCCC
     TCGGGCGGGGAAGACCGACGGGGGGGCTGAGGCTGCGACTCAGGATAAGGAGGTACGGGG

LeuGluGlyGluProGlyAspProAspLeuSerAspGlySerTrpSerThrValSerSer
5821 CCCTGGAGGGGGAGCCTGGGGATCCGGATCTTAGCGACGGGTCATGGTCAACGGTCAGTA
     GGGACCTCCCCCTCGGACCCCTAGGCCTAGAATCGCTGCCCAGTACCAGTTGCCAGTCAT

GluAlaAsnAlaGluAspValValCysCysSerMetSerTyrSerTrpThrGlyAlaLeu
5881 GTGAGGCCAACGCGGAGGATGTCGTGTGCTGCTCAATGTCTTACTCTTGGACAGGCGCAC
     CACTCCGGTTGCGCCTCCTACAGCACACGACGAGTTACAGAATGAGAACCTGTCCGCGTG

ValThrProCysAlaAlaGluGluGlnLysLeuProIleAsnAlaLeuSerAsnSerLeu
5941 TCGTCACCCCGTGCGCCGCGGAAGAACAGAAACTGCCCATCAATGCACTAAGCAACTCGT
     AGCAGTGGGGCACGCGGCGCCTTCTTGTCTTTGACGGGTAGTTACGTGATTCGTTGAGCA

LeuArgHisHisAsnLeuValTyrSerThrThrSerArgSerAlaCysGlnArgGlnLys
6001 TGCTACGTCACCACAATTTGGTGTATTCCACCACCTCACGCAGTGCTTGCCAAAGGCAGA
     ACGATGCAGTGGTGTTAAACCACATAAGGTGGTGGAGTGCGTCACGAACGGTTTCCGTCT
```

FIG. 47G

```
          LysValThrPheAspArgLeuGlnValLeuAspSerHisTyrGlnAspValLeuLysGlu
6061 AGAAAGTCACATTTGACAGACTGCAAGTTCTGGACAGCCATTACCAGGACGTACTCAAGG
     TCTTTCAGTGTAAACTGTCTGACGTTCAAGACCTGTCGGTAATGGTCCTGCATGAGTTCC

ValLysAlaAlaAlaSerLysValLysAlaAsnLeuLeuSerValGluGluAlaCysSer
6121 AGGTTAAAGCAGCGGCGTCAAAAGTGAAGGCTAACTTGCTATCCGTAGAGGAAGCTTGCA
     TCCAATTTCGTCGCCGCAGTTTTCACTTCCGATTGAACGATAGGCATCTCCTTCGAACGT

LeuThrProProHisSerAlaLysSerLysPheGlyTyrGlyAlaLysAspValArgCys
6181 GCCTGACGCCCCCACACTCAGCCAAATCCAAGTTTGGTTATGGGGCAAAAGACGTCCGTT
     CGGACTGCGGGGGTGTGAGTCGGTTTAGGTTCAAACCAATACCCCGTTTTCTGCAGGCAA

HisAlaArgLysAlaValThrHisIleAsnSerValTrpLysAspLeuLeuGluAspAsn
6241 GCCATGCCAGAAAGGCCGTAACCCACATCAACTCCGTGTGGAAAGACCTTCTGGAAGACA
     CGGTACGGTCTTTCCGGCATTGGGTGTAGTTGAGGCACACCTTTCTGGAAGACCTTCTGT

ValThrProIleAspThrThrIleMetAlaLysAsnGluValPheCysValGlnProGlu
6301 ATGTAACACCAATAGACACTACCATCATGGCTAAGAACGAGGTTTTCTGCGTTCAGCCTG
     TACATTGTGGTTATCTGTGATGGTAGTACCGATTCTTGCTCCAAAAGACGCAAGTCGGAC

LysGlyGlyArgLysProAlaArgLeuIleValPheProAspLeuGlyValArgValCys
6361 AGAAGGGGGGTCGTAAGCCAGCTCGTCTCATCGTGTTCCCCGATCTGGGCGTGCGCGTGT
     TCTTCCCCCCAGCATTCGGTCGAGCAGAGTAGCACAAGGGGCTAGACCCGCACGCGCACA

GluLysMetAlaLeuTyrAspValValThrLysLeuProLeuAlaValMetGlySerSer
6421 GCGAAAAGATGGCTTTGTACGACGTGGTTACAAAGCTCCCCTTGGCCGTGATGGGAAGCT
     CGCTTTTCTACCGAAACATGCTGCACCAATGTTTCGAGGGGAACCGGCACTACCCTTCGA

TyrGlyPheGlnTyrSerProGlyGlnArgValGluPheLeuValGlnAlaTrpLysSer
6481 CCTACGGATTCCAATACTCACCAGGACAGCGGGTTGAATTCCTCGTGCAAGCGTGGAAGT
     GGATGCCTAAGGTTATGAGTGGTCCTGTCGCCCAACTTAAGGAGCACGTTCGCACCTTCA

LysLysThrProMetGlyPheSerTyrAspThrArgCysPheAspSerThrValThrGlu
6541 CCAAGAAAACCCCAATGGGGTTCTCGTATGATACCCGCTGCTTTGACTCCACAGTCACTG
     GGTTCTTTTGGGGTTACCCCAAGAGCATACTATGGGCGACGAAACTGAGGTGTCAGTGAC

SerAspIleArgThrGluGluAlaIleTyrGlnCysCysAspLeuAspProGlnAlaArg
6601 AGAGCGACATCCGTACGGAGGAGGCAATCTACCAATGTTGTGACCTCGACCCCCAAGCCC
     TCTCGCTGTAGGCATGCCTCCTCCGTTAGATGGTTACAACACTGGAGCTGGGGGTTCGGG

ValAlaIleLysSerLeuThrGluArgLeuTyrValGlyGlyProLeuThrAsnSerArg
6661 GCGTGGCCATCAAGTCCCTCACCGAGAGGCTTTATGTTGGGGGCCCTCTTACCAATTCAA
     CGCACCGGTAGTTCAGGGAGTGGCTCTCCGAAATACAACCCCCGGGAGAATGGTTAAGTT

GlyGluAsnCysGlyTyrArgArgCysArgAlaSerGlyValLeuThrThrSerCysGly
6721 GGGGGGAGAACTGCGGCTATCGCAGGTGCCGCGCGAGCGGCGTACTGACAACTAGCTGTG
     CCCCCCTCTTGACGCCGATAGCGTCCACGGCGCGCTCGCCGCATGACTGTTGATCGACAC

AsnThrLeuThrCysTyrIleLysAlaArgAlaAlaCysArgAlaAlaGlyLeuGlnAsp
6781 GTAACACCCTCACTTGCTACATCAAGGCCCGGGCAGCCTGTCGAGCCGCAGGGCTCCAGG
     CATTGTGGGAGTGAACGATGTAGTTCCGGGCCCGTCGGACAGCTCGGCGTCCCGAGGTCC

CysThrMetLeuValCysGlyAspAspLeuValValIleCysGluSerAlaGlyValGln
6841 ACTGCACCATGCTCGTGTGTGGCGACGACTTAGTCGTTATCTGTGAAAGCGCGGGGGTCC
     TGACGTGGTACGAGCACACACCGCTGCTGAATCAGCAATAGACACTTTCGCGCCCCCAGG

GluAspAlaAlaSerLeuArgAlaPheThrGluAlaMetThrArgTyrSerAlaProPro
6901 AGGAGGACGCGGCGAGCCTGAGAGCCTTCACGGAGGCTATGACCAGGTACTCCGCCCCCC
     TCCTCCTGCGCCGCTCGGACTCTCGGAAGTGCCTCCGATACTGGTCCATGAGGCGGGGGG

GlyAspProProGlnProGluTyrAspLeuGluLeuIleThrSerCysSerSerAsnVal
6961 CTGGGGACCCCCCACAACCAGAATACGACTTGGAGCTCATAACATCATGCTCCTCCAACG
     GACCCCTGGGGGGTGTTGGTCTTATGCTGAACCTCGAGTATTGTAGTACGAGGAGGTTGC

SerValAlaHisAspGlyAlaGlyLysArgValTyrTyrLeuThrArgAspProThrThr
7021 TGTCAGTCGCCCACGACGGCGCTGGAAAGAGGGTCTACTACCTCACCCGTGACCCTACAA
     ACAGTCAGCGGGTGCTGCCGCGACCTTTCTCCCAGATGATGGAGTGGGCACTGGGATGTT
```

FIG. 47H

```
         ProLeuAlaArgAlaAlaTrpGluThrAlaArgHisThrProValAsnSerTrpLeuGly
7081 CCCCCCTCGCGAGAGCTGCGTGGGAGACAGCAAGACACACTCCAGTCAATTCCTGGCTAG
     GGGGGGAGCGCTCTCGACGCACCCTCTGTCGTTCTGTGTGAGGTCAGTTAAGGACCGATC

AsnIleIleMetPheAlaProThrLeuTrpAlaArgMetIleLeuMetThrHisPhePhe
7141 GCAACATAATCATGTTTGCCCCCACACTGTGGGCGAGGATGATACTGATGACCCATTTCT
     CGTTGTATTAGTACAAACGGGGGTGTGACACCCGCTCCTACTATGACTACTGGGTAAAGA

SerValLeuIleAlaArgAspGlnLeuGluGlnAlaLeuAspCysGluIleTyrGlyAla
7201 TTAGCGTCCTTATAGCCAGGGACCAGCTTGAACAGGCCCTCGATTGCGAGATCTACGGGG
     AATCGCAGGAATATCGGTCCCTGGTCGAACTTGTCCGGGAGCTAACGCTCTAGATGCCCC

CysTyrSerIleGluProLeuAspLeuProProIleIleGlnArgLeu
7261 CCTGCTACTCCATAGAACCACTTGATCTACCTCCAATCATTCAAAGACTC
     GGACGATGAGGTATCTTGGTGAACTAGATGGAGGTTAGTAAGTTTCTGAG
```

FIG. 48

```
      ProSerProValValValGlyThrThrAspArgSerGlyAlaProThrTyrSerTrpGly
  1 CTCCCAGCCCCGTGGTGGTGGGAACGACCGACAGGTCGGGCGGCCTACCTACAGCTGGG
    GAGGGTCGGGGCACCACCACCCTTGCTGCCTGTCCAGCCCGCCGGATGGATGTCGACCC
             GluAsnAspThrAspValPheValLeuAsnAsnThrArgProLeuGlyAsnTrpPhe
 61 GTGAAAATGATACGGACGTCTTCGTCCTTAACAATACCAGGCCACCGCTGGCAATTGGT
    CACTTTTACTATGCCTGCAGAAGCAGGAATTGTTATGGTCCGGTGGCGACCGTTAACCA
                   GlyCysThrTrpMetAsnSerThrGlyPheThrLysValCysGlyAlaProProCysVal
121 TCGGTTGTACCTGGATGAACTAACTGGATTCACCAAAGTGTGCGGAGCGCCTCCTTGTG
    AGCCAACATGGACCTACTTGAGTTGACCTAAGTGTTCACACGCCTCGCGGAGGAACAC
                          IleGlyGlyAlaGlyAsnAsnThrLeuHisCysProThrAspCysPheArgLysHisPro
181 TCATCGGAGGGCGGGCAACAACACCCTGCACTGCCCCACTGATTGCTTCCGCAAGCATC
    AGTAGCCTCCCGCCCGTTGTTGTGGGACGTGACGGGGTGACTAACGAAGGCGTTCGTAG
                                 AspAlaThrTyrSerArgCysGlySerGlyProTrpLeuThrProArgCysLeuValAsp
241 CGGACGCCACATACTCTCGGGTGCGGCTCCGGGTCCCTGGCTCACACCCAGGTGCCTGGTCG
    GCCTGCGGTGTATGAGAGCCCACGCCGAGGCCAGGACCGAGTGTGGGTCCACGGACCAGC
                                         TyrProTyrArgLeuTrpHisTyrProCysThrIleAsnTyrThrIlePheLysIleArg
301 ACTACCCGTATAGGCTTTGGCATTATCCTTGTACCATCAACTACACACCATATTAAAATCA
    TGATGGGCATATCCGAAACCGTAATAGGAACATGGTAGTTGATGTGGTATAAATTTTAGT
                                                -----Overlap with 12f-----
             MetTyrValGlyLeuGlyValGluHisArgLeuGluAlaAlaCysAsnTrpThrArgGlyGlu
361 GGATGTACGTGGAGGGTCGAGCACAGGCTGGAAGCTGCCTGCAACTGGACGCGGGCG
    CCTACATGCACCTCCCAGCTCGTCGTCCGACGTTCGACGGACGTTGACCTGCGCCCCGC
                                                     ArgCysAspLeuGluAspArgAspArgSerGluLeuSerProLeuLeuThrThrThr
421 AACGTTGCGATCTGGAAGACAGGACAGGTCCGAGCTCCAGCCCGTTACTGCTGACCACTA
    TTGCAACGCTAGACCTTCTGTCCTGTCCAGGCTCGAGTGCGGCAATGACGACTGGTGAT
                                                     GlnTrpGlnValLeuProCysSerPheThrThrLeuProAlaLeuSerThrGlyLeu
481 CACAGTGGCAGTGGCAGGTCCTCCCGTGTTCCTTCACAACCCTGCCAGCCTTGTCCACCGCCTCA
    GTGTCACCGTCCAGGAGGGCACAAGGAAGTGTTGGGACGGTCGGAACAGGTGCCGGAGT
```

FIG. 49

```
    LeuPheTyrHisLysPheAsnSerSerGlyCysProGluArgLeuAlaSerCysArg
  1 GCTTTCTATCACCACAAGTTCAACTCTTCAGGCTGTCCTGAGAGGCTAGCCAGCTGCCG
    CGAAAGATAGTGGTGTTCAAGTTGAGAAGTCCGACAGACTCTCCGATCGGTCGACGGC
    ProLeuThrAspPheAspGlnGlyTrpGlyProIleSerTyrAlaAsnGlySerGlyPro
 61 ACCCCTTACCGATTTGACCAGGGCTGGGGCCCTATCAGTTATGCCAACGGAAGCGGCCC
    TGGGGAATGGCTAAACTGGTCCCGACCCCGGGATAGTCAATACGGTTGCCTTCGCCGGG
    AspGlnArgProTyrCysTrpHisTyrProProLysProCysGlyIleValProAlaLys
121 CGACCAGCGCCCTACTGCTGGCACTACCCCCCAAAACCTTGCGGTATTGTGCCCGCGAA
    GCTGGTCGCGGGATGACGACCGTGATGGGGGTTTTGGAACGCCATAACACGGGCGCTT
                         ---Overlap with 13i---
    SerValCysGlyProValTyrCysPheThrProSerProValVal
181 GAGTGTGTGTGCCGGTATATTGCTTCACTCCCAGCCCCGTGGTGGG
    CTCACACACACGGCCATATAACGAAGTGAGGGTCGGGGCACCACCC
```

FIG. 50

```
    LeuValMetAlaGlnLeuLeuArgIleProGlnAlaIleLeuLeuAspMetIleAlaGlyAla
  1 TTGGTAATGGCTCAGCTCCTGCTCCGGATCCCACAAGCCATCTTGGACATGATCGCTGGTGCT
    AACCATTACCGAGTCGACGAGGCCTAGGGTGTTCGGTAGAACCTGTACTAGCGACCACGA

HisTrpGlyValLeuLeuAlaGlyIleAlaTyrPheSerMetValGlyAsnTrpAlaLysVal
 61 CACTGGGGAGTCCTGGCGGCCATAGCGTATTCTCCATGGTGGGAACTGGGCGAAGGTC
    GTGACCCCTCAGGACCGCCGCCGGTATCGCATAAAGAGGTACCACCCCTTGACCCGCTTCCAG

LeuValValLeuLeuPheAlaGlyValAspAlaGluThrHisValThrGlyGlySer
121 CTGGTAGTGCTGCTGTTTGCCGGCGTCGACGCGGAAACCCACGTCACCGGGGAAGT
    GACCATCACGACGACGATAAACGCCCAGCTGCGCCTTTGGGTGCAGTGGCCCCCTTCA

AlaGlyHisThrValSerGlyPheValSerLeuLeuAlaProGlyAlaLysGlnAsnVal
181 GCCGGCCACACTGTGTCTGGATTTGTTAGCCTCTCGCACCAGGCGCAAGCAGAACGTC
    CGGCCGGTGTGACACAGACCTAAACAATCGGAGGAGCGTGGTCCGCGGTTCGTCTTGCAG

GlnLeuIleAsnThrAsnGlySerTrpHisLeuAsnSerThrAlaLeuAsnCysAsnAsp
241 CAGCTGATCAACACCAACGGCAGTTGGCACCTCAATAGCACGGCCCTGAACTGCAATGAT
    GTCGACTAGTTGTGGTTGCCGTCAACCGTGGAGTTATCGTGCCGGGACTTGACGTTACTA

SerLeuAsnThrGlyTyrHisHisLysPheAsnSerSerGly
301 AGCCTCAACACCGGCTGGTTGGCAGGCTTTTCTATCACCACAAGTTCAACTCTTCAGGC
    TCGGAGTTGTGGCCGACCAACCGTCCGAAAAGATAGTGGTGTTCAAGTTGAGAAGTCCG

CysProGluArgLeuAlaSerCysArgPro
361 TGTCCTGAGAGGCTAGCCAGCTGCCGACCCC
    ACAGGACTCTCCGATCGGTCGACGGCTGGGG
```

-----Overlap with K9-1------

------Overlap with 26j------

FIG. 51

```
    GlnGlyCysAsnCysSerIleTyrProGlyHisIleThrGlyHisArgMetAlaTrpAsp
  1 CGCAAGGTTGCAATTGCTCTATCCCGGCCATATAACGGGTCACCGGCATGGCATGGG
    GCGTTCCAAGTTAACGAGATAGGGCCGGTATATTGCCCAGTGGCGTACCGTACCC
                                           |—————————————————|
     MetMetMetAsnTrpSerProThrThrAlaLeuValMetAlaGlnLeuLeuArgIlePro
 61 ATATGATGATGAACTGGTCCCCTACGACGGCGTTGGTAATGGCCTCAGCTGCTCCGGATCC
    TATACTACTACTTGACCAGGGATGCTGCCGCAACCATTACCGGAGTCGACGAGGCCTAGG
    |———————————————————————————————————————————————————————|
     GlnAlaIleLeuAspMetIleAlaGlyAlaAlaHisTrpGlyValLeuAlaAlaGlyIleAlaTyr
121 CACAAGCCATCTTGGACACATGATCGCTGGTGCTCACTGGGGAGTCCTGGCGGGCATAGCGT
    GTGTTCGGTAGAACCTGTACTAGCGACCACGAGTGACCCCTCAGGACCGCCCGTATCGCA
    |————————Overlap with CA59a————————|
     PheSerMetValGlyAsnTrpAlaLysValLeuValLeuLeuValLeuLeuPheAlaGlyVal
181 ATTTCTATGGTTGGGAACTGGGCGAAGGTCCTGGTAGTGCTGCTGCTATTTGCCGGCG
    TAAAGAGTACCAACCCCTTGACCCGCTTCCAGGACCATCACGACGACGATAAACGGCCGC
    |—————————|
     AspAlaGluThrHisValThrGly
241 TCGACGCGGGAAACCCACGTCACCGGGG
    AGCTGCGCCTTTGGGTGCAGTGGCCCC
```

FIG. 52

```
    CysTrpValAlaMetThrProThrValAlaThrArgAspGlyLysLeuProAlaThrGln
  1 GTGTGGGTGGCGATGACCCCTACGGTGGCCACCAGGGGATGGCAAACTCCCCGCGACGCA
    CACAACCCACCGCTACTGGGGATGCCACCGGTGGTCCCTACCGTTTGAGGGGCGCTGCGT

LeuArgArgHisIleAspLeuLeuValGlySerAlaThrLeuCysSerAlaLeuTyrVal
 61 GCTTCGACGTCACATCGATCTGCTTGTCGGGAGCGCCACCCTCTGTTCGGCCCTCTACGT
    CGAAGCTGCAGTGTAGCTAGACGAACAGCCCTCGCGGTGGGAGACAAGCCGGGAGATGCA

GlyAspLeuCysGlySerValPheLeuValGlyGlnLeuPheThrPheSerProArgArg
121 GGGGGACCTATGCGGGTCTGTCTTTCTTGTCGGCCAACTGTTCACCTTCTCCCCAGGCG
    CCCCCTGGATACGCCCAGACAGAAAGAACAGCCGGTTGACAAGTGGAAGAGGGTCCGC

HisTrpThrThrGlnGlyCysAsnCysSerIleTyrProGlyHisIleThrGlyHisArg
181 CCACTGGACGACGCAAGGTTGCAATTGCTCTATCTATCCCGGCCATATAACGGGTCACCG
    GGTGACCTGCTGCTGCGTTCCAACGTTAACGAGATAGATAGGGCCGGTATATTGCCCAGTGGC

-------Overlap with CA84a-------
    MetAlaTrpAspMetMetAsnTrpSerProThrAlaLeuValValAlaGlnLeu
241 CATGGCATGGGATATGATGAACTGGTCCCCTACGACGGCGGTTGGTAGTGGCTCAGCT
    GTACCGTACCCTATACTACTTGACCAGGACTGCCGCCAACCATCACCGAGTCGA LeuArgIleProGlnAla
301 GCTCCGGATCCCCAAGCC
    CGAGGCCTAGGGGTGTTCGG
```

FIG. 53

```
    SerThrGlyLeuTyrHisValThrAsnAspCysProAsnSerSerIleValTyrGluAla
  1 CTCCACGGGCTTTACCACGTCACCAATGATTGCCCTAACTCGAGTATTGTTACGAGGC
    GAGGTGCCCGAAATGGTGCAGTGGTTACTAACGGATTGAGCTCATAACACATGCTCCG

AlaAspAlaIleLeuHisThrProGlyCysValProCysValArgGluGlyAsnAlaSer
 61 GGCCGATGCCATCCTGCACACTCCGGGGTGCGTCCCTTGCGTTCGTGAGGGCAACGCCTC
    CCGGCTACGGTAGGACGTGTGAGGCCCCACGCAGGGAACGCAAGCACTCCCGTTGCGGAG

ArgCysTrpValAlaMetThrProThrValAlaThrArgAspGlyLysLeuProAlaThr
121 GAGGTGTGGGTGGCGATGACCCCTACGGTGGCCACCAGGGATGGCAAACTCCCCGGAC
    CTCCACAACCCACGCTACTGGGGATGCCACCGGTGGTCCCTACCGTTTGAGGGGCGCTG

-----------------------Overlap with Ca156e-------------

GlnLeuArgArgHisIleAspLeuLeuValGlySerAlaThrLeuCysSerAlaLeuTyr
181 GCAGCTTCGACGTCACATCGATCTGCTTGTCGGGAGCGCTACCCTCTGTTCGGCCCCTA
    CGTCGAAGCTGCAGTGTAGCTAGACGAACAGCCCTCGCGATGGGAGACAAGCCGGGAGAT

ValGlyAspLeuCysGlySerValPheLeu
241 CGTGGGGGACTTGTGCGGGTCTGTCTTTCTTG
    GCACCCCCTGAACACGCCCAGACAGAAAGAAC
```

FIG. 54A

```
    ArgSerArgAsnLeuGlyLysValIleAspThrLeuThrCysGlyPheAlaAspLeuMet
  1 AGGTCGCGCAATTTGGGTAAGGTCATCGATACCCTTACGTGCGGCTTCGCCGACCTCATG
    TCCAGCGCGTTAAACCCATTCCAGTAGCTATGGGAATGCACGCCGAAGCGGCTGGAGTAC

GlyTyrIleProLeuValGlyAlaProLeuGlyGlyAlaAlaArgAlaLeuAlaHisGly
 61 GGGTACATACCGCTCGTCGGCGCCCCTCTTGGAGGCGCTGCCAGGGCCCTGGCGCATGGC
    CCCATGTATGGCGAGCAGCCGCGGGGAGAACCTCCGCGACGGTCCCGGGACCGCGTACCG

ValArgValLeuGluAspGlyValAsnTyrAlaThrGlyAsnLeuProGlyCysSerPhe
121 GTCCGGGTTCTGGAAGACGGCGTGAACTATGCAACAGGGAACCTTCCTGGTTGCTCTTTC
    CAGGCCCAAGACCTTCTGCCGCACTTGATACGTTGTCCCTTGGAAGGACCAACGAGAAAG

SerIlePheLeuLeuAlaLeuLeuSerCysLeuThrValProAlaSerAlaTyrGlnVal
181 TCTATCTTCCTTCTGGCCCTGCTCTCTTGCTTGACTGTGCCCGCTTCGGCCTACCAAGTG
    AGATAGAAGGAAGACCGGGACGAGAGAACGAACTGACACGGGCGAAGCCGGATGGTTCAC

ArgAsnSerThrGlyLeuTyrHisValThrAsnAspCysProAsnSerSerIleValTyr
241 CGCAACTCCACGGGGCTTTACCACGTCACCAATGATTGCCCTAACTCGAGTATTGTGTAC
    GCGTTGAGGTGCCCCGAAATGGTGCAGTGGTTACTAACGGGATTGAGCTCATAACACATG

GluAlaAlaAspAlaIleLeuHisThrProGlyCysValProCysValArgGluGlyAsn
301 GAGGCGGCCGATGCCATCCTGCACACTCCGGGGTGCGTCCCTTGCGTTCGTGAGGGCAAC
    CTCCGCCGGCTACGGTAGGACGTGTGAGGCCCCACGCAGGGAACGCAAGCACTCCCGTTG

AlaSerArgCysTrpValAlaMetThrProThrValAlaThrArgAspGlyLysLeuPro
361 GCCTCGAGGTGTTGGGTGGCGATGACCCCTACGGTGGCCACCAGGGATGGCAAACTCCCC
    CGGAGCTCCACAACCCACCGCTACTGGGGATGCCACCGGTGGTCCCTACCGTTTGAGGGG

AlaThrGlnLeuArgArgHisIleAspLeuLeuValGlySerAlaThrLeuCysSerAla
421 GCGACGCAGCTTCGACGTCACATCGATCTGCTTGTCGGGAGCGCCACCCTCTGTTCGGCC
    CGCTGCGTCGAAGCTGCAGTGTAGCTAGACGAACAGCCCTCGCGGTGGGAGACAAGCCGG

LeuTyrValGlyAspLeuCysGlySerValPheLeuValGlyGlnLeuPheThrPheSer
481 CTCTACGTGGGGGACCTATGCGGGTCTGTCTTTCTTGTCGGCCAACTGTTCACCTTCTCT
    GAGATGCACCCCCTGGATACGCCCAGACAGAAAGAACAGCCGGTTGACAAGTGGAAGAGA

ProArgArgHisTrpThrThrGlnGlyCysAsnCysSerIleTyrProGlyHisIleThr
541 CCCAGGCGCCACTGGACGACGCAAGGTTGCAATTGCTCTATCTATCCCGGCCATATAACG
    GGGTCCGCGGTGACCTGCTGCGTTCCAACGTTAACGAGATAGATAGGGCCGGTATATTGC

GlyHisArgMetAlaTrpAspMetMetMetAsnTrpSerProThrThrAlaLeuValMet
601 GGTCACCGCATGGCATGGGATATGATGATGAACTGGTCCCCTACGACGGCGTTGGTAATG
    CCAGTGGCGTACCGTACCCTATACTACTACTTGACCAGGGGATGCTGCCGCAACCATTAC
```

FIG. 54B

```
     AlaGlnLeuLeuArgIleProGlnAlaIleLeuAspMetIleAlaGlyAlaHisTrpGly
 661 GCTCAGCTGCTCCGGATCCCACAAGCCATCTTGGACATGATCGCTGGTGCTCACTGGGGA
     CGAGTCGACGAGGCCTAGGGTGTTCGGTAGAACCTGTACTAGCGACCACGAGTGACCCCT

ValLeuAlaGlyIleAlaTyrPheSerMetValGlyAsnTrpAlaLysValLeuValVal
 721 GTCCTGGCGGGCATAGCGTATTTCTCCATGGTGGGGAACTGGGCGAAGGTCCTGGTAGTG
     CAGGACCGCCCGTATCGCATAAAGAGGTACCACCCCTTGACCCGCTTCCAGGACCATCAC

LeuLeuLeuPheAlaGlyValAspAlaGluThrHisValThrGlyGlySerAlaGlyHis
 781 CTGCTGCTATTTGCCGGCGTCGACGCGGAAACCCACGTCACCGGGGGAAGTGCCGGCCAC
     GACGACGATAAACGGCCGCAGCTGCGCCTTTGGGTGCAGTGGCCCCCTTCACGGCCGGTG

ThrValSerGlyPheValSerLeuLeuAlaProGlyAlaLysGlnAsnValGlnLeuIle
 841 ACTGTGTCTGGATTTGTTAGCCTCCTCGCACCAGGCGCCAAGCAGAACGTCCAGCTGATC
     TGACACAGACCTAAACAATCGGAGGAGCGTGGTCCGCGGTTCGTCTTGCAGGTCGACTAG

AsnThrAsnGlySerTrpHisLeuAsnSerThrAlaLeuAsnCysAsnAspSerLeuAsn
 901 AACACCAACGGCAGTTGGCACCTCAATAGCACGGCCCTGAACTGCAATGATAGCCTCAAC
     TTGTGGTTGCCGTCAACCGTGGAGTTATCGTGCCGGGACTTGACGTTACTATCGGAGTTG

ThrGlyTrpLeuAlaGlyLeuPheTyrHisHisLysPheAsnSerSerGlyCysProGlu
 961 ACCGGCTGGTTGGCAGGGCTTTTCTATCACCACAAGTTCAACTCTTCAGGCTGTCCTGAG
     TGGCCGACCAACCGTCCCGAAAAGATAGTGGTGTTCAAGTTGAGAAGTCCGACAGGACTC

ArgLeuAlaSerCysArgProLeuThrAspPheAspGlnGlyTrpGlyProIleSerTyr
1021 AGGCTAGCCAGCTGCCGACCCCTTACCGATTTTGACCAGGGCTGGGGCCCTATCAGTTAT
     TCCGATCGGTCGACGGCTGGGGAATGGCTAAAACTGGTCCCGACCCCGGGATAGTCAATA

AlaAsnGlySerGlyProAspGlnArgProTyrCysTrpHisTyrProProLysProCys
1081 GCCAACGGAAGCGGCCCCGACCAGCGCCCCTACTGCTGGCACTACCCCCCAAAACCTTGC
     CGGTTGCCTTCGCCGGGGCTGGTCGCGGGGATGACGACCGTGATGGGGGGTTTTGGAACG

GlyIleValProAlaLysSerValCysGlyProValTyrCysPheThrProSerProVal
1141 GGTATTGTGCCCGCGAAGAGTGTGTGTGGTCCGGTATATTGCTTCACTCCCAGCCCCGTG
     CCATAACACGGGCGCTTCTCACACACACCAGGCCATATAACGAAGTGAGGGTCGGGGCAC

ValValGlyThrThrAspArgSerGlyAlaProThrTyrSerTrpGlyGluAsnAspThr
1201 GTGGTGGGAACGACCGACAGGTCGGGCGCGCCCACCTACAGCTGGGGTGAAAATGATACG
     CACCACCCTTGCTGGCTGTCCAGCCCGCGCGGGTGGATGTCGACCCCACTTTTACTATGC

AspValPheValLeuAsnAsnThrArgProProLeuGlyAsnTrpPheGlyCysThrTrp
1261 GACGTCTTCGTCCTTAACAATACCAGGCCACCGCTGGGCAATTGGTTCGGTTGTACCTGG
     CTGCAGAAGCAGGAATTGTTATGGTCCGGTGGCGACCCGTTAACCAAGCCAACATGGACC

MetAsnSerThrGlyPheThrLysValCysGlyAlaProProCysValIleGlyGlyAla
1321 ATGAACTCAACTGGATTCACCAAAGTGTGCGGAGCGCCTCCTTGTGTCATCGGAGGGGCG
     TACTTGAGTTGACCTAAGTGGTTTCACACGCCTCGCGGAGGAACACAGTAGCCTCCCCGC

GlyAsnAsnThrLeuHisCysProThrAspCysPheArgLysHisProAspAlaThrTyr
1381 GGCAACAACACCCTGCACTGCCCCACTGATTGCTTCCGCAAGCATCCGGACGCCACATAC
     CCGTTGTTGTGGGACGTGACGGGGTGACTAACGAAGGCGTTCGTAGGCCTGCGGTGTATG

SerArgCysGlySerGlyProTrpIleThrProArgCysLeuValAspTyrProTyrArg
1441 TCTCGGTGCGGCTCCGGTCCCTGGATCACACCCAGGTGCCTGGTCGACTACCCGTATAGG
     AGAGCCACGCCGAGGCCAGGGACCTAGTGTGGGTCCACGGACCAGCTGATGGGCATATCC

LeuTrpHisTyrProCysThrIleAsnTyrThrIlePheLysIleArgMetTyrValGly
1501 CTTTGGCATTATCCTTGTACCATCAACTACACCATATTTAAAATCAGGATGTACGTGGGA
     GAAACCGTAATAGGAACATGGTAGTTGATGTGGTATAAATTTTAGTCCTACATGCACCCT

GlyValGluHisArgLeuGluAlaAlaCysAsnTrpThrArgGlyGluArgCysAspLeu
1561 GGGGTCGAACACAGGCTGGAAGCTGCCTGCAACTGGACGCGGGGCGAACGTTGCGATCTG
     CCCCAGCTTGTGTCCGACCTTCGACGGACGTTGACCTGCGCCCCGCTTGCAACGCTAGAC

GluAspArgAspArgSerGluLeuSerProLeuLeuLeuThrThrThrGlnTrpGlnVal
1621 GAAGACAGGGACAGGTCCGAGCTCAGCCCGTTACTGCTGACCACTACACAGTGGCAGGTC
     CTTCTGTCCCTGTCCAGGCTCGAGTCGGGCAATGACGACTGGTGATGTGTCACCGTCCAG
```

FIG. 54C

```
     LeuProCysSerPheThrThrLeuProAlaLeuSerThrGlyLeuIleHisLeuHisGln
1681 CTCCCGTGTTCCTTCACAACCCTACCAGCCTTGTCCACCGGCCTCATCCACCTCCACCAG
     GAGGGCACAAGGAAGTGTTGGGATGGTCGGAACAGGTGGCCGGAGTAGGTGGAGGTGGTC

AsnIleValAspValGlnTyrLeuTyrGlyValGlySerSerIleAlaSerTrpAlaIle
1741 AACATTGTGGACGTGCAGTACTTGTACGGGGTGGGGTCAAGCATCGCGTCCTGGGCCATT
     TTGTAACACCTGCACGTCATGAACATGCCCCACCCCAGTTCGTAGCGCAGGACCCGGTAA

LysTrpGluTyrValValLeuLeuPheLeuLeuLeuAlaAspAlaArgValCysSerCys
1801 AAGTGGGAGTACGTCGTTCTCCTGTTCCTTCTGCTTGCAGACGCGCGCGTCTGCTCCTGC
     TTCACCCTCATGCAGCAAGAGGACAAGGAAGACGAACGTCTGCGCGCGCAGACGAGGACG

LeuTrpMetMetLeuLeuIleSerGlnAlaGluAlaAlaLeuGluAsnLeuValIleLeu
1861 TTGTGGATGATGCTACTCATATCCCAAGCGGAGGCGGCTTTGGAGAACCTCGTAATACTT
     AACACCTACTACGATGAGTATAGGGTTCGCCTCCGCCGAAACCTCTTGGAGCATTATGAA

AsnAlaAlaSerLeuAlaGlyThrHisGlyLeuValSerPheLeuValPhePheCysPhe
1921 AATGCAGCATCCCTGGCCGGGACGCACGGTCTTGTATCCTTCCTCGTGTTCTTCTGCTTT
     TTACGTCGTAGGGACCGGCCCTGCGTGCCAGAACATAGGAAGGAGCACAAGAAGACGAAA

AlaTrpTyrLeuLysGlyLysTrpValProGlyAlaValTyrThrPheTyrGlyMetTrp
1981 GCATGGTATTTGAAGGGTAAGTGGGTGCCCGGAGCGGTCTACACCTTCTACGGGATGTGG
     CGTACCATAAACTTCCCATTCACCCACGGGCCTCGCCAGATGTGGAAGATGCCCTACACC

ProLeuLeuLeuLeuLeuLeuAlaLeuProGlnArgAlaTyrAlaLeuAspThrGluVal
2041 CCTCTCCTCCTGCTCCTGTTGGCGTTGCCCCAGCGGGCGTACGCGCTGGACACGGAGGTG
     GGAGAGGAGGACGAGGACAACCGCAACGGGGTCGCCCGCATGCGCGACCTGTGCCTCCAC

AlaAlaSerCysGlyGlyValValLeuValGlyLeuMetAlaLeuThrLeuSerProTyr
2101 GCCGCGTCGTGTGGCGGTGTTGTTCTCGTCGGGTTGATGGCGCTGACTCTGTCACCATAT
     CGGCGCAGCACACCGCCACAACAAGAGCAGCCCAACTACCGCGACTGAGACAGTGGTATA

TyrLysArgTyrIleSerTrpCysLeuTrpTrpLeuGlnTyrPheLeuThrArgValGlu
2161 TACAAGCGCTATATCAGCTGGTGCTTGTGGTGGCTTCAGTATTTTCTGACCAGAGTGGAA
     ATGTTCGCGATATAGTCGACCACGAACACCACCGAAGTCATAAAAGACTGGTCTCACCTT

AlaGlnLeuHisValTrpIleProProLeuAsnValArgGlyGlyArgAspAlaValIle
2221 GCGCAACTGCACGTGTGGATTCCCCCCCTCAACGTCCGAGGGGGGCGCGACGCCGTCATC
     CGCGTTGACGTGCACACCTAAGGGGGGGAGTTGCAGGCTCCCCCCGCGCTGCGGCAGTAG

LeuLeuMetCysAlaValHisProThrLeuValPheAspIleThrLysLeuLeuLeuAla
2281 TTACTCATGTGTGCTGTACACCCGACTCTGGTATTTGACATCACCAAATTGCTGCTGGCC
     AATGAGTACACACGACATGTGGGCTGAGACCATAAACTGTAGTGGTTTAACGACGACCGG

ValPheGlyProLeuTrpIleLeuGlnAlaSerLeuLeuLysValProTyrPheValArg
2341 GTCTTCGGACCCCTTTGGATTCTTCAAGCCAGTTTGCTTAAAGTACCCTACTTTGTGCGC
     CAGAAGCCTGGGGAAACCTAAGAAGTTCGGTCAAACGAATTTCATGGGATGAAACACGCG

ValGlnGlyLeuLeuArgPheCysAlaLeuAlaArgLysMetIleGlyGlyHisTyrVal
2401 GTCCAAGGCCTTCTCCGGTTCTGCGCGTTAGCGCGGAAGATGATCGGAGGCCATTACGTG
     CAGGTTCCGGAAGAGGCCAAGACGCGCAATCGCGCCTTCTACTAGCCTCCGGTAATGCAC

GlnMetValIleIleLysLeuGlyAlaLeuThrGlyThrTyrValTyrAsnHisLeuThr
2461 CAAATGGTCATCATTAAGTTAGGGGCGCTTACTGGCACCTATGTTTATAACCATCTCACT
     GTTTACCAGTAGTAATTCAATCCCCGCGAATGACCGTGGATACAAATATTGGTAGAGTGA

ProLeuArgAspTrpAlaHisAsnGlyLeuArgAspLeuAlaValAlaValGluProVal
2521 CCTCTTCGGGACTGGGCGCACAACCGCTTGCGAGATCTGGCCGTGGCTGTAGAGCCAGTC
     GGAGAAGCCCTGACCCGCGTGTTGCCGAACGCTCTAGACCGGCACCGACATCTCGGTCAG

ValPheSerGlnMetGluThrLysLeuIleThrTrpGlyAlaAspThrAlaAlaCysGly
2581 GTCTTCTCCCAAATGGAGACCAAGCTCATCACGTGGGGGGCAGATACCGCCGCGTGCGGT
     CAGAAGAGGGTTTACCTCTGGTTCGAGTAGTGCACCCCCGTCTATGGCGGCGCACGCCA

AspIleIleAsnGlyLeuProValSerAlaArgArgGlyArgGluIleLeuLeuGlyPro
2641 GACATCATCAACGGCTTGCCTGTTTCCGCCCGCAGGGGCCGGGAGATACTGCTCGGGCCA
     CTGTAGTAGTTGCCGAACGGACAAAGGCGGGCGTCCCCGGCCCTCTATGACGAGCCCGGT
```

FIG. 54D

```
           AlaAspGlyMetValSerLysGlyTrpArgLeuLeuAlaProIleThrAlaTyrAlaGln
2701  GCCGATGGAATGGTCTCCAAGGGGTGGAGGTTGCTGGCGCCCATCACGGCGTACGCCCAG
      CGGCTACCTTACCAGAGGTTCCCCACCTCCAACGACCGCGGGTAGTGCCGCATGCGGGTC

GlnThrArgGlyLeuLeuGlyCysIleIleThrSerLeuThrGlyArgAspLysAsnGln
2761  CAGACAAGGGGCCTCCTAGGGTGCATAATCACCAGCCTAACTGGCCGGGACAAAAACCAA
      GTCTGTTCCCCGGAGGATCCCACGTATTAGTGGTCGGATTGACCGGCCCTGTTTTTGGTT

ValGluGlyGluValGlnIleValSerThrAlaAlaGlnThrPheLeuAlaThrCysIle
2821  GTGGAGGGTGAGGTCCAGATTGTGTCAACTGCTGCCCAAACCTTCCTGGCAACGTGCATC
      CACCTCCCACTCCAGGTCTAACACAGTTGACGACGGGTTTGGAAGGACCGTTGCACGTAG

AsnGlyValCysTrpThrValTyrHisGlyAlaGlyThrArgThrIleAlaSerProLys
2881  AATGGGGTGTGCTGGACTGTCTACCACGGGGCCGGAACGAGGACCATCGCGTCACCCAAG
      TTACCCCACACGACCTGACAGATGGTGCCCCGGCCTTGCTCCTGGTAGCGCAGTGGGTTC

GlyProValIleGlnMetTyrThrAsnValAspGlnAspLeuValGlyTrpProAlaPro
2941  GGTCCTGTCATCCAGATGTATACCAATGTAGACCAAGACCTTGTGGGCTGGCCCGCTCCG
      CCAGGACAGTAGGTCTACATATGGTTACATCTGGTTCTGGAACACCCGACCGGGCGAGGC

GlnGlySerArgSerLeuThrProCysThrCysGlySerSerAspLeuTyrLeuValThr
3001  CAAGGTAGCCGCTCATTGACACCCTGCACTTGCGGCTCCTCGGACCTTTACCTGGTCACG
      GTTCCATCGGCGAGTAACTGTGGGACGTGAACGCCGAGGAGCCTGGAAATGGACCAGTGC

ArgHisAlaAspValIleProValArgArgArgGlyAspSerArgGlySerLeuLeuSer
3061  AGGCACGCCGATGTCATTCCCGTGCGCCGGCGGGGTGATAGCAGGGGCAGCCTGCTGTCG
      TCCGTGCGGCTACAGTAAGGGCACGCGGCCGCCCCACTATCGTCCCCGTCGGACGACAGC

ProArgProIleSerTyrLeuLysGlySerSerGlyGlyProLeuLeuCysProAlaGly
3121  CCCCGGCCCATTTCCTACTTGAAAGGCTCCTCGGGGGGTCCGCTGTTGTGCCCCGCGGGG
      GGGGCCGGGTAAAGGATGAACTTTCCGAGGAGCCCCCCAGGCGACAACACGGGGCGCCCC

HisAlaValGlyIlePheArgAlaAlaValCysThrArgGlyValAlaLysAlaValAsp
3181  CACGCCGTGGGCATATTTAGGGCCGCGGTGTGCACCCGTGGAGTGGCTAAGGCGGTGGAC
      GTGCGGCACCCGTATAAATCCCGGCGCCACACGTGGGCACCTCACCGATTCCGCCACCTG

PheIleProValGluAsnLeuGluThrThrMetArgSerProValPheThrAspAsnSer
3241  TTTATCCCTGTGGAGAACCTAGAGACAACCATGAGGTCCCCGGTGTTCACGGATAACTCC
      AAATAGGGACACCTCTTGGATCTCTGTTGGTACTCCAGGGGCCACAAGTGCCTATTGAGG

SerProProValValProGlnSerPheGlnValAlaHisLeuHisAlaProThrGlySer
3301  TCTCCACCAGTAGTGCCCCAGAGCTTCCAGGTGGCTCACCTCCATGCTCCCACAGGCAGC
      AGAGGTGGTCATCACGGGGTCTCGAAGGTCCACCGAGTGGAGGTACGAGGGTGTCCGTCG

GlyLysSerThrLysValProAlaAlaTyrAlaAlaGlnGlyTyrLysValLeuValLeu
3361  GGCAAAAGCACCAAGGTCCCGGCTGCATATGCAGCTCAGGGCTATAAGGTGCTAGTACTC
      CCGTTTTCGTGGTTCCAGGGCCGACGTATACGTCGAGTCCCGATATTCCACGATCATGAG

AsnProSerValAlaAlaThrLeuGlyPheGlyAlaTyrMetSerLysAlaHisGlyIle
3421  AACCCCTCTGTTGCTGCAACACTGGGCTTTGGTGCTTACATGTCCAAGGCTCATGGGATC
      TTGGGGAGACAACGACGTTGTGACCCGAAACCACGAATGTACAGGTTCCGAGTACCCTAG

AspProAsnIleArgThrGlyValArgThrIleThrThrGlySerProIleThrTyrSer
3481  GATCCTAACATCAGGACCGGGGTGAGAACAATTACCACTGGCAGCCCCATCACGTACTCC
      CTAGGATTGTAGTCCTGGCCCCACTCTTGTTAATGGTGACCGTCGGGGTAGTGCATGAGG

ThrTyrGlyLysPheLeuAlaAspGlyGlyCysSerGlyGlyAlaTyrAspIleIleIle
3541  ACCTACGGCAAGTTCCTTGCCGACGGCGGGTGCTCGGGGGGCGCTTATGACATAATAATT
      TGGATGCCGTTCAAGGAACGGCTGCCGCCCACGAGCCCCCGCGAATACTGTATTATTAA

CysAspGluCysHisSerThrAspAlaThrSerIleLeuGlyIleGlyThrValLeuAsp
3601  TGTGACGAGTGCCACTCCACGGATGCCACATCCATCTTGGGCATCGGCACTGTCCTTGAC
      ACACTGCTCACGGTGAGGTGCCTACGGTGTAGGTAGAACCCGTAGCCGTGACAGGAACTG
```

FIG. 54E

```
      GlnAlaGluThrAlaGlyAlaArgLeuValValLeuAlaThrAlaThrProProGlySer
3661  CAAGCAGAGACTGCGGGGGCGAGACTGGTTGTGCTCGCCACCGCCACCCCTCCGGGCTCC
      GTTCGTCTCTGACGCCCCCGCTCTGACCAACACGAGCGGTGGCGGTGGGGAGGCCCGAGG

ValThrValProHisProAsnIleGluGluValAlaLeuSerThrThrGlyGluIlePro
3721  GTCACTGTGCCCCATCCCAACATCGAGGAGGTTGCTCTGTCCACCACCGGAGAGATCCCT
      CAGTGACACGGGGTAGGGTTGTAGCTCCTCCAACGAGACAGGTGGTGGCCTCTCTAGGGA

PheTyrGlyLysAlaIleProLeuGluValIleLysGlyGlyArgHisLeuIlePheCys
3781  TTTTACGGCAAGGCTATCCCCCTCGAAGTAATCAAGGGGGGGAGACATCTCATCTTCTGT
      AAAATGCCGTTCCGATAGGGGGAGCTTCATTAGTTCCCCCCCTCTGTAGAGTAGAAGACA

HisSerLysLysLysCysAspGluLeuAlaAlaLysLeuValAlaLeuGlyIleAsnAla
3841  CATTCAAAGAAGAAGTGCGACGAACTCGCCGCAAAGCTGGTCGCATTGGGCATCAATGCC
      GTAAGTTTCTTCTTCACGCTGCTTGAGCGGCGTTTCGACCAGCGTAACCCGTAGTTACGG

ValAlaTyrTyrArgGlyLeuAspValSerValIleProThrSerGlyAspValValVal
3901  GTGGCCTACTACCGCGGTCTTGACGTGTCCGTCATCCCGACCAGCGGCGATGTTGTCGTC
      CACCGGATGATGGCGCCAGAACTGCACAGGCAGTAGGGCTGGTCGCCGCTACAACAGCAG

ValAlaThrAspAlaLeuMetThrGlyTyrThrGlyAspPheAspSerValIleAspCys
3961  GTGGCAACCGATGCCCTCATGACCGGCTATACCGGCGACTTCGACTCGGTGATAGACTGC
      CACCGTTGGCTACGGGAGTACTGGCCGATATGGCCGCTGAAGCTGAGCCACTATCTGACG

AsnThrCysValThrGlnThrValAspPheSerLeuAspProThrPheThrIleGluThr
4021  AATACGTGTGTCACCCAGACAGTCGATTTCAGCCTTGACCCTACCTTCACCATTGAGACA
      TTATGCACACAGTGGGTCTGTCAGCTAAAGTCGGAACTGGGATGGAAGTGGTAACTCTGT

IleThrLeuProGlnAspAlaValSerArgThrGlnArgArgGlyArgThrGlyArgGly
4081  ATCACGCTCCCCCAGGATGCTGTCTCCCGCACTCAACGTCGGGGCAGGACTGGCAGGGGG
      TAGTGCGAGGGGGTCCTACGACAGAGGGCGTGAGTTGCAGCCCCGTCCTGACCGTCCCCC

LysProGlyIleTyrArgPheValAlaProGlyGluArgProSerGlyMetPheAspSer
4141  AAGCCAGGCATCTACAGATTTGTGGCACCGGGGGAGCGCCCCTCCGGCATGTTCGACTCG
      TTCGGTCCGTAGATGTCTAAACACCGTGGCCCCCTCGCGGGGAGGCCGTACAAGCTGAGC

SerValLeuCysGluCysTyrAspAlaGlyCysAlaTrpTyrGluLeuThrProAlaGlu
4201  TCCGTCCTCTGTGAGTGCTATGACGCAGGCTGTGCTTGGTATGAGCTCACGCCCGCCGAG
      AGGCAGGAGACACTCACGATACTGCGTCCGACACGAACCATACTCGAGTGCGGGCGGCTC

ThrThrValArgLeuArgAlaTyrMetAsnThrProGlyLeuProValCysGlnAspHis
4261  ACTACAGTTAGGCTACGAGCGTACATGAACACCCCGGGGCTTCCCGTGTGCCAGGACCAT
      TGATGTCAATCCGATGCTCGCATGTACTTGTGGGGCCCCGAAGGGCACACGGTCCTGGTA

LeuGluPheTrpGluGlyValPheThrGlyLeuThrHisIleAspAlaHisPheLeuSer
4321  CTTGAATTTTGGGAGGGCGTCTTTACAGGCCTCACTCATATAGATGCCCACTTTCTATCC
      GAACTTAAAACCCTCCCGCAGAAATGTCCGGAGTGAGTATATCTACGGGTGAAAGATAGG

GlnThrLysGlnSerGlyGluAsnLeuProTyrLeuValAlaTyrGlnAlaThrValCys
4381  CAGACAAAGCAGAGTGGGGAGAACCTTCCTTACCTGGTAGCGTACCAAGCCACCGTGTGC
      GTCTGTTTCGTCTCACCCCTCTTGGAAGGAATGGACCATCGCATGGTTCGGTGGCACACG

AlaArgAlaGlnAlaProProProSerTrpAspGlnMetTrpLysCysLeuIleArgLeu
4441  GCTAGGGCTCAAGCCCCTCCCCCATCGTGGGACCAGATGTGGAAGTGTTTGATTCGCCTC
      CGATCCCGAGTTCGGGGAGGGGGTAGCACCCTGGTCTACACCTTCACAAACTAAGCGGAG

LysProThrLeuHisGlyProThrProLeuLeuTyrArgLeuGlyAlaValGlnAsnGlu
4501  AAGCCCACCCTCCATGGGCCAACACCCCTGCTATACAGACTGGGCGCTGTTCAGAATGAA
      TTCGGGTGGGAGGTACCCGGTTGTGGGGACGATATGTCTGACCCGCGACAAGTCTTACTT

IleThrLeuThrHisProValThrLysTyrIleMetThrCysMetSerAlaAspLeuGlu
4561  ATCACCCTGACGCACCCAGTCACCAAATACATCATGACATGCATGTCGGCCGACCTGGAG
      TAGTGGGACTGCGTGGGTCAGTGGTTTATGTAGTACTGTACGTACAGCCGGCTGGACCTC

ValValThrSerThrTrpValLeuValGlyGlyValLeuAlaAlaLeuAlaAlaTyrCys
4621  GTCGTCACGAGCACCTGGGTGCTCGTTGGCGGCGTCCTGGCTGCTTTGGCCGCGTATTGC
      CAGCAGTGCTCGTGGACCCACGAGCAACCGCCGCAGGACCGACGAAACCGGCGCATAACG
```

FIG. 54F

```
     LeuSerThrGlyCysValValIleValGlyArgValValLeuSerGlyLysProAlaIle
4681 CTGTCAACAGGCTGCGTGGTCATAGTGGGCAGGGTCGTCTTGTCCGGGAAGCCGGCAATC
     GACAGTTGTCCGACGCACCAGTATCACCCGTCCCAGCAGAACAGGCCCTTCGGCCGTTAG

IleProAspArgGluValLeuTyrArgGluPheAspGluMetGluGluCysSerGlnHis
4741 ATACCTGACAGGGAAGTCCTCTACCGAGAGTTCGATGAGATGGAAGAGTGCTCTCAGCAC
     TATGGACTGTCCCTTCAGGAGATGGCTCTCAAGCTACTCTACCTTCTCACGAGAGTCGTG

LeuProTyrIleGluGlnGlyMetMetLeuAlaGluGlnPheLysGlnLysAlaLeuGly
4801 TTACCGTACATCGAGCAAGGGATGATGCTCGCCGAGCAGTTCAAGCAGAAGGCCCTCGGC
     AATGGCATGTAGCTCGTTCCCTACTACGAGCGGCTCGTCAAGTTCGTCTTCCGGGAGCCG

LeuLeuGlnThrAlaSerArgGlnAlaGluValIleAlaProAlaValGlnThrAspTrp
4861 CTCCTGCAGACCGCGTCCCGTCAGGCAGAGGTTATCGCCCCTGCTGTCCAGACCAACTGG
     GAGGACGTCTGGCGCAGGGCAGTCCGTCTCCAATAGCGGGGACGACAGGTCTGGTTGACC

GlnLysLeuGluThrPheTrpAlaLysHisMetTrpAsnPheIleSerGlyIleGlnTyr
4921 CAAAAACTCGAGACCTTCTGGGCGAAGCATATGTGGAACTTCATCAGTGGGATACAATAC
     GTTTTTGAGCTCTGGAAGACCCGCTTCGTATACACCTTGAAGTAGTCACCCTATGTTATG

LeuAlaGlyLeuSerThrLeuProGlyAsnProAlaIleAlaSerLeuMetAlaPheThr
4981 TTGGCGGGCTTGTCAACGCTGCCTGGTAACCCCGCCATTGCTTCATTGATGGCTTTTACA
     AACCGCCCGAACAGTTGCGACGGACCATTGGGGCGGTAACGAAGTAACTACCGAAAATGT

AlaAlaValThrSerProLeuThrThrSerGlnThrLeuLeuPheAsnIleLeuGlyGly
5041 GCTGCTGTCACCAGCCCACTAACCACTAGCCAAACCCTCCTCTTCAACATATTGGGGGGG
     CGACGACAGTGGTCGGGTGATTGGTGATCGGTTTGGGAGGAGAAGTTGTATAACCCCCCC

TrpValAlaAlaGlnLeuAlaAlaProGlyAlaAlaThrAlaPheValGlyAlaGlyLeu
5101 TGGGTGGCTGCCCAGCTCGCCGCCCCCGGTGCCGCTACTGCCTTTGTGGGCGCTGGCTTA
     ACCCACCGACGGGTCGAGCGGCGGGGGCCACGGCGATGACGGAAACACCCGCGACCGAAT

AlaGlyAlaAlaIleGlySerValGlyLeuGlyLysValLeuIleAspIleLeuAlaGly
5161 GCTGGCGCCGCCATCGGCAGTGTTGGACTGGGGAAGGTCCTCATAGACATCCTTGCAGGG
     CGACCGCGGCGGTAGCCGTCACAACCTGACCCCTTCCAGGAGTATCTGTAGGAACGTCCC

TyrGlyAlaGlyValAlaGlyAlaLeuValAlaPheLysIleMetSerGlyGluValPro
5221 TATGGCGCGGGCGTGGCGGGAGCTCTTGTGGCATTCAAGATCATGAGCGGTGAGGTCCCC
     ATACCGCGCCCGCACCGCCCTCGAGAACACCGTAAGTTCTAGTACTCGCCACTCCAGGGG

SerThrGluAspLeuValAsnLeuLeuProAlaIleLeuSerProGlyAlaLeuValVal
5281 TCCACGGAGGACCTGGTCAATCTACTGCCCGCCATCCTCTCGCCCGGAGCCCTCGTAGTC
     AGGTGCCTCCTGGACCAGTTAGATGACGGGCGGTAGGAGAGCGGGCCTCGGGAGCATCAG

GlyValValCysAlaAlaIleLeuArgArgHisValGlyProGlyGluGlyAlaValGln
5341 GGCGTGGTCTGTGCAGCAATACTGCGCCGGCACGTTGGCCCGGGCGAGGGGGCAGTGCAG
     CCGCACCAGACACGTCGTTATGACGCGGCCGTGCAACCGGGCCCGCTCCCCCGTCACGTC

TrpMetAsnArgLeuIleAlaPheAlaSerArgGlyAsnHisValSerProThrHisTyr
5401 TGGATGAACCGGCTGATAGCCTTCGCCTCCCGGGGGAACCATGTTTCCCCCACGCACTAC
     ACCTACTTGGCCGACTATCGGAAGCGGAGGGCCCCCTTGGTACAAAGGGGTGCGTGATG

ValProGluSerAspAlaAlaAlaArgValThrAlaIleLeuSerSerLeuThrValThr
5461 GTGCCGGAGAGCGATGCAGCTGCCCGCGTCACTGCCATACTCAGCAGCCTCACTGTAACC
     CACGGCCTCTCGCTACGTCGACGGGCGCAGTGACGGTATGAGTCGTCGGAGTGACATTGG

GlnLeuLeuArgArgLeuHisGlnTrpIleSerSerGluCysThrThrProCysSerGly
5521 CAGCTCCTGAGGCGACTGCACCAGTGGATAAGCTCGGAGTGTACCACTCCATGCTCCGGT
     GTCGAGGACTCCGCTGACGTGGTCACCTATTCGAGCCTCACATGGTGAGGTACGAGGCCA

SerTrpLeuArgAspIleTrpAspTrpIleCysGluValLeuSerAspPheLysThrTrp
5581 TCCTGGCTAAGGGACATCTGGGACTGGATATGCGAGGTGTTGAGCGACTTTAAGACCTGG
     AGGACCGATTCCCTGTAGACCCTGACCTATACGCTCCACAACTCGCTGAAATTCTGGACC

LeuLysAlaLysLeuMetProGlnLeuProGlyIleProPheValSerCysGlnArgGly
5641 CTAAAAGCTAAGCTCATGCCACAGCTGCCTGGGATCCCCTTTGTGTCCTGCCAGCGCGGG
     GATTTTCGATTCGAGTACGGTGTCGACGGACCCTAGGGGAAACACAGGACGGTCGCGCCC
```

FIG. 54G

```
     TyrLysGlyValTrpArgValAspGlyIleMetHisThrArgCysHisCysGlyAlaGlu
5701 TATAAGGGGGTCTGGCGAGTGGACGGCATCATGCACACTCGCTGCCACTGTGGAGCTGAG
     ATATTCCCCCAGACCGCTCACCTGCCGTAGTACGTGTGAGCGACGGTGACACCTCGACTC

IleThrGlyHisValLysAsnGlyThrMetArgIleValGlyProArgThrCysArgAsn
5761 ATCACTGGACATGTCAAAAACGGGACGATGAGGATCGTCGGTCCTAGGACCTGCAGGAAC
     TAGTGACCTGTACAGTTTTTGCCCTGCTACTCCTAGCAGCCAGGATCCTGGACGTCCTTG

MetTrpSerGlyThrPheProIleAsnAlaTyrThrThrGlyProCysThrProLeuPro
5821 ATGTGGAGTGGGACCTTCCCCATTAATGCCTACACCACGGGCCCTGTACCCCCCTTCCT
     TACACCTCACCCTGGAAGGGGTAATTACGGATGTGGTGCCCGGGGACATGGGGGGAAGGA

AlaProAsnTyrThrPheAlaLeuTrpArgValSerAlaGluGluTyrValGluIleArg
5881 GCGCCGAACTACACGTTCGCGCTATGGAGGGTGTCTGCAGAGGAATATGTGGAGATAAGG
     CGCGGCTTGATGTGCAAGCGCGATACCTCCCACAGACGTCTCCTTATACACCTCTATTCC

GlnValGlyAspPheHisTyrValThrGlyMetThrThrAspAsnLeuLysCysProCys
5941 CAGGTGGGGGACTTCCACTACGTGACGGGTATGACTACTGACAATCTCAAATGCCCGTGC
     GTCCACCCCCTGAAGGTGATGCACTGCCCATACTGATGACTGTTAGAGTTTACGGGCACG

GlnValProSerProGluPhePheThrGluLeuAspGlyValArgLeuHisArgPheAla
6001 CAGGTCCCATCGCCCGAATTTTTCACAGAATTGGACGGGGTGCGCCTACATAGGTTTGCG
     GTCCAGGGTAGCGGGCTTAAAAAGTGTCTTAACCTGCCCCACGCGGATGTATCCAAACGC

ProProCysLysProLeuLeuArgGluGluValSerPheArgValGlyLeuHisGluTyr
6061 CCCCCCTGCAAGCCCTTGCTGCGGGAGGAGGTATCATTCAGAGTAGGACTCCACGAATAC
     GGGGGGACGTTCGGGAACGACGCCCTCCTCCATAGTAAGTCTCATCCTGAGGTGCTTATG

ProValGlySerGlnLeuProCysGluProGluProAspValAlaValLeuThrSerMet
6121 CCGGTAGGGTCGCAATTACCTTGCGAGCCCGAACCGGACGTGGCCGTGTTGACGTCCATG
     GGCCATCCCAGCGTTAATGGAACGCTCGGGCTTGGCCTGCACCGGCACAACTGCAGGTAC

LeuThrAspProSerHisIleThrAlaGluAlaAlaGlyArgArgLeuAlaArgGlySer
6181 CTCACTGATCCCTCCCATATAACAGCAGAGGCGGCCGGGCGAAGGTTGGCGAGGGGATCA
     GAGTGACTAGGGAGGGTATATTGTCGTCTCCGCCGGCCCGCTTCCAACCGCTCCCCTAGT

ProProSerValAlaSerSerSerAlaSerGlnLeuSerAlaProSerLeuLysAlaThr
6241 CCCCCCTCTGTGGCCAGCTCCTCGGCTAGCCAGCTATCCGCTCCATCTCTCAAGGCAACT
     GGGGGGAGACACCGGTCGAGGAGCCGATCGGTCGATAGGCGAGGTAGAGAGTTCCGTTGA

CysThrAlaAsnHisAspSerProAspAlaGluLeuIleGluAlaAsnLeuLeuTrpArg
6301 TGCACCGCTAACCATGACTCCCCTGATGCTGAGCTCATAGAGGCCAACCTCCTATGGAGG
     ACGTGGCGATTGGTACTGAGGGGACTACGACTCGAGTATCTCCGGTTGGAGGATACCTCC

GlnGluMetGlyGlyAsnIleThrArgValGluSerGluAsnLysValValIleLeuAsp
6361 CAGGAGATGGGCGGCAACATCACCAGGGTTGAGTCAGAAAACAAAGTGGTGATTCTGGAC
     GTCCTCTACCCGCCGTTGTAGTGGTCCCAACTCAGTCTTTTGTTTCACCACTAAGACCTG

SerPheAspProLeuValAlaGluGluAspGluArgGluIleSerValProAlaGluIle
6421 TCCTTCGATCCGCTTGTGGCGGAGGAGGACGAGCGGGAGATCTCCGTACCCGCAGAAATC
     AGGAAGCTAGGCGAACACCGCCTCCTCCTGCTCGCCCTCTAGAGGCATGGGCGTCTTTAG

LeuArgLysSerArgArgPheAlaGlnAlaLeuProValTrpAlaArgProAspTyrAsn
6481 CTGCGGAAGTCTCGGAGATTCGCCCAGGCCCTGCCCGTTTGGGCGCGGCCGGACTATAAC
     GACGCCTTCAGAGCCTCTAAGCGGGTCCGGGACGGGCAAACCCGCGCCGGCCTGATATTG

ProProLeuValGluThrTrpLysLysProAspTyrGluProProValValHisGlyCys
6541 CCCCCGCTAGTGGAGACGTGGAAAAAGCCCGACTACGAACCACCTGTGGTCCATGGCTGT
     GGGGGCGATCACCTCTGCACCTTTTTCGGGCTGATGCTTGGTGGACACCAGGTACCGACA

ProLeuProProProLysSerProProValProProProArgLysLysArgThrValVal
6601 CCGCTTCCACCTCCAAAGTCCCCTCCTGTGCCTCCGCCTCGGAAGAAGCGGACGGTGGTC
     GGCGAAGGTGGAGGTTTCAGGGGAGGACACGGAGGCGGAGCCTTCTTCGCCTGCCACCAG

LeuThrGluSerThrLeuSerThrAlaLeuAlaGluLeuAlaThrArgSerPheGlySer
6661 CTCACTGAATCAACCCTATCTACTGCCTTGGCCGAGCTCGCCACCAGAAGCTTTGGCAGC
     GAGTGACTTAGTTGGGATAGATGACGGAACCGGCTCGAGCGGTGGTCTTCGAAACCGTCG
```

FIG. 54H

```
          SerSerThrSerGlyIleThrGlyAspAsnThrThrThrSerSerGluProAlaProSer
6721 TCCTCAACTTCCGGCATTACGGGCGACAATACGACAACATCCTCTGAGCCCGCCCCTTCT
     AGGAGTTGAAGGCCGTAATGCCCGCTGTTATGCTGTTGTAGGAGACTCGGGCGGGGAAGA

GlyCysProProAspSerAspAlaGluSerTyrSerSerMetProProLeuGluGlyGlu
6781 GGCTGCCCCCCCGACTCCGACGCTGAGTCCTATTCCTCCATGCCCCCCCTGGAGGGGGAG
     CCGACGGGGGGGCTGAGGCTGCGACTCAGGATAAGGAGGTACGGGGGGGACCTCCCCCTC

ProGlyAspProAspLeuSerAspGlySerTrpSerThrValSerSerGluAlaAsnAla
6841 CCTGGGGATCCGGATCTTAGCGACGGGTCATGGTCAACGGTCAGTAGTGAGGCCAACGCG
     GGACCCCTAGGCCTAGAATCGCTGCCCAGTACCAGTTGCCAGTCATCACTCCGGTTGCGC

GluAspValValCysCysSerMetSerTyrSerTrpThrGlyAlaLeuValThrProCys
6901 GAGGATGTCGTGTGCTGCTCAATGTCTTACTCTTGGACAGGCGCACTCGTCACCCCGTGC
     CTCCTACAGCACACGACGAGTTACAGAATGAGAACCTGTCCGCGTGAGCAGTGGGGCACG

AlaAlaGluGluGlnLysLeuProIleAsnAlaLeuSerAsnSerLeuLeuArgHisHis
6961 GCCGCGGAAGAACAGAAACTGCCCATCAATGCACTAAGCAACTCGTTGCTACGTCACCAC
     CGGCGCCTTCTTGTCTTTGACGGGTAGTTACGTGATTCGTTGAGCAACGATGCAGTGGTG

AsnLeuValTyrSerThrThrSerArgSerAlaCysGlnArgGlnLysLysValThrPhe
7021 AATTTGGTGTATTCCACCACCTCACGCAGTGCTTGCCAAAGGCAGAAGAAAGTCACATTT
     TTAAACCACATAAGGTGGTGGAGTGCGTCACGAACGGTTTCCGTCTTCTTTCAGTGTAAA

AspARgLeuGlnValLeuAspSerHisTyrGlnAspValLeuLysGluValLysAlaAla
7081 GACAGACTGCAAGTTCTGGACAGCCATTACCAGGACGTACTCAAGGAGGTTAAAGCAGCG
     CTGTCTGACGTTCAAGACCTGTCGGTAATGGTCCTGCATGAGTTCCTCCAATTTCGTCGC

AlaSerLysValLysAlaAsnLeuLeuSerValGluGluAlaCysSerLeuThrProPro
7141 GCGTCAAAAGTGAAGGCTAACTTGCTATCCGTAGAGGAAGCTTGCAGCCTGACGCCCCCA
     CGCAGTTTTCACTTCCGATTGAACGATAGGCATCTCCTTCGAACGTCGGACTGCGGGGGT

HisSerAlaLysSerLysPheGlyTyrGlyAlaLysAspValArgCysHisAlaArgLys
7201 CACTCAGCCAAATCCAAGTTTGGTTATGGGGCAAAAGACGTCCGTTGCCATGCCAGAAAG
     GTGAGTCGGTTTAGGTTCAAACCAATACCCCGTTTTCTGCAGGCAACGGTACGGTCTTTC

AlaValThrHisIleAsnSerValTrpLysAspLeuLeuGluAspAsnValThrProIle
7261 GCCGTAACCCACATCAACTCCGTGTGGAAAGACCTTCTGGAAGACAATGTAACACCAATA
     CGGCATTGGGTGTAGTTGAGGCACACCTTTCTGGAAGACCTTCTGTTACATTGTGGTTAT

AspThrThrIleMetAlaLysAsnGluValPheCysValGlnProGluLysGlyGlyArg
7321 GACACTACCATCATGGCTAAGAACGAGGTTTTCTGCGTTCAGCCTGAGAAGGGGGGTCGT
     CTGTGATGGTAGTACCGATTCTTGCTCCAAAAGACGCAAGTCGGACTCTTCCCCCCAGCA

LysProAlaArgLeuIleValPheProAspLeuGlyValArgValCysGluLysMetAla
7381 AAGCCAGCTCGTCTCATCGTGTTCCCCGATCTGGGCGTGCGCGTGTGCGAAAAGATGGCT
     TTCGGTCGAGCAGAGTAGCACAAGGGGCTAGACCCGCACGCGCACACGCTTTTCTACCGA

LeuTyrAspValValThrLysLeuProLeuAlaValMetGlySerSerTyrGlyPheGln
7441 TTGTACGACGTGGTTACAAAGCTCCCCTTGGCCGTGATGGGAAGCTCCTACGGATTCCAA
     AACATGCTGCACCAATGTTTCGAGGGGAACCGGCACTACCCTTCGAGGATGCCTAAGGTT

TyrSerProGlyGlnArgValGluPheLeuValGlnAlaTrpLysSerLysLysThrPro
7501 TACTCACCAGGACAGCGGGTTGAATTCCTCGTGCAAGCGTGGAAGTCCAAGAAAACCCCA
     ATGAGTGGTCCTGTCGCCCAACTTAAGGAGCACGTTCGCACCTTCAGGTTCTTTTGGGGT

MetGlyPheSerTyrAspThrArgCysPheAspSerThrValThrGluSerAspIleArg
7561 ATGGGGTTCTCGTATGATACCCGCTGCTTTGACTCCACAGTCACTGAGAGCGACATCCGT
     TACCCCAAGAGCATACTATGGGCGACGAAACTGAGGTGTCAGTGACTCTCGCTGTAGGCA

ThrGluGluAlaIleTyrGlnCysCysAspLeuAspProGlnAlaArgValAlaIleLys
7621 ACGGAGGAGGCAATCTACCAATGTTGTGACCTCGACCCCCAAGCCCGCGTGGCCATCAAG
     TGCCTCCTCCGTTAGATGGTTACAACACTGGAGCTGGGGGTTCGGGCGCACCGGTAGTTC

SerLeuThrGluArgLeuTyrValGlyGlyProLeuThrAsnSerArgGlyGluAsnCys
7681 TCCCTCACCGAGAGGCTTTATGTTGGGGGCCCTCTTACCAATTCAAGGGGGGAGAACTGC
     AGGGAGTGGCTCTCCGAAATACAACCCCCGGGAGAATGGTTAAGTTCCCCCCTCTTGACG
```

FIG. 54I

```
       GlyTyrArgArgCysArgAlaSerGlyValLeuThrThrSerCysGlyAsnThrLeuThr
7741   GGCTATCGCAGGTGCCGCGCGAGCGGCGTACTGACAACTAGCTGTGGTAACACCCTCACT
       CCGATAGCGTCCACGGCGCGCTCGCCGCATGACTGTTGATCGACACCATTGTGGGAGTGA

CysTyrIleLysAlaArgAlaAlaCysArgAlaAlaGlyLeuGlnAspCysThrMetLeu
7801   TGCTACATCAAGGCCCGGGCAGCCTGTCGAGCCGCAGGGCTCCAGGACTGCACCATGCTC
       ACGATGTAGTTCCGGGCCCGTCGGACAGCTCGGCGTCCCGAGGTCCTGACGTGGTACGAG

ValCysGlyAspAspLeuValValIleCysGluSerAlaGlyValGlnGluAspAlaAla
7861   GTGTGTGGCGACGACTTAGTCGTTATCTGTGAAAGCGCGGGGGTCCAGGAGGACGCGGCG
       CACACACCGCTGCTGAATCAGCAATAGACACTTTCGCGCCCCCAGGTCCTCCTGCGCCGC

SerLeuArgAlaPheThrGluAlaMetThrArgTyrSerAlaProProGlyAspProPro
7921   AGCCTGAGAGCCTTCACGGAGGCTATGACCAGGTACTCCGCCCCCCCTGGGGACCCCCCA
       TCGGACTCTCGGAAGTGCCTCCGATACTGGTCCATGAGGCGGGGGGGACCCCTGGGGGGT

GlnProGluTyrAspLeuGluLeuIleThrSerCysSerSerAsnValSerValAlaHis
7981   CAACCAGAATACGACTTGGAGCTCATAACATCATGCTCCTCCAACGTGTCAGTCGCCCAC
       GTTGGTCTTATGCTGAACCTCGAGTATTGTAGTACGAGGAGGTTGCACAGTCAGCGGGTG

AspGlyAlaGlyLysArgValTyrTyrLeuThrArgAspProThrThrProLeuAlaArg
8041   GACGGCGCTGGAAAGAGGGTCTACTACCTCACCCGTGACCCTACAACCCCCCTCGCGAGA
       CTGCCGCGACCTTTCTCCCAGATGATGGAGTGGGCACTGGGATGTTGGGGGGAGCGCTCT

AlaAlaTrpGluThrAlaArgHisThrProValAsnSerTrpLeuGlyAsnIleIleMet
8101   GCTGCGTGGGAGACAGCAAGACACACTCCAGTCAATTCCTGGCTAGGCAACATAATCATG
       CGACGCACCCTCTGTCGTTCTGTGTGAGGTCAGTTAAGGACCGATCCGTTGTATTAGTAC

PheAlaProThrLeuTrpAlaArgMetIleLeuMetThrHisPhePheSerValLeuIle
8161   TTTGCCCCCACACTGTGGGCGAGGATGATACTGATGACCCATTTCTTTAGCGTCCTTATA
       AAACGGGGGTGTGACACCCGCTCCTACTATGACTACTGGGTAAAGAAATCGCAGGAATAT

AlaArgAspGlnLeuGluGlnAlaLeuAspCysGluIleTyrGlyAlaCysTyrSerIle
8221   GCCAGGGACCAGCTTGAACAGGCCCTCGATTGCGAGATCTACGGGCCTGCTACTCCATA
       CGGTCCCTGGTCGAACTTGTCCGGGAGCTAACGCTCTAGATGCCCCGGACGATGAGGTAT

GluProLeuAspLeuProProIleIleGlnArgLeu
8281   GAACCACTTGATCTACCTCCAATCATTCAAAGACTC
       CTTGGTGAACTAGATGGAGGTTAGTAAGTTTCTGAG
```

FIG. 56

```
     ArgArgSerArgArgAsnLeuGlyLysValIleAspThrLeuThrCysGlyPheAlaAsp
  1  CCCGGCGTAGGTCGCGCAATTGGGTAAGGTCATCGATACCCTTACGTGCGGCTTCGCCG
     GGGCCGCATCCAGCGCGTTAAACCCATTCCAGTAGCTATGGGAATGCACGCCGAAGCGGC

LeuMetGlyTyrIleProLeuValGlyAlaProLeuGlyAlaArgAlaLeuAla
 61  ACCTCATGGGGTACATACCGCTCGTCGGCGCCCCTCTTGGAGGCGCTGCCAGGCCCTGG
     TGGAGTACCCCATGTATGGCGAGCAGCCGCGGGGAGAACCTCCGCGACGGTCCCGGACC

HisGlyValArgValLeuGluAspGlyValAlaThrGlyAsnLeuProGlyCys
121  CGCATGGGCGGTTCCGGGTTCTGAAGACGGCGTGAACTATGCAACAGGGAACCTTCCTGTT
     GCGTACCCGCCAAGAGCCCAAGACTTCTGCCGACACTTGATACGTTGTCCCTTGAAGGACCAA

SerPheSerIlePheLeuLeuAlaLeuLeuSerCysLeuThrValProAlaSerAlaTyr
181  GCTCTTCTCTATCTTCCTTCTGGCCCTCTTGCTTGACCTGTGCCCGCTTCGCCT
     CGAGAAGAGATAGAAGAAGGAAGACCGGGACGAGAACGAACTGACACGGGCGAAGCCGGA

----------overlap with Ca167b----------
     GlnValArgAsnSerThrGlyLeuTyrHisValThrAsnAspCysProAsnSerIle
241  ACCAAGTGCGCAACTCCACGGGCTTTACCACAGTCACCAATGATTGCCCTAACTCGAGTA
     TGGTTCACGCGTTGAGGTGCCCGAAATGGTGTCAGTGGTTACTAACGGGATTGAGCTCAT ----------overlap with Ca167b----------
     ValTyrGluAlaAlaAspAlaIleLeuHisThrProGlyCysValProCysValArgGlu
301  TTGTGTACGAAGCGGCCGATGCCATCCTGCACACTCCGGGGTGCGTCCCTTGCGTTCGTG
     AACACATGCTTCGCCGGCTACGGTAGGACGTGTGAGGCCCCACGCAGGAGACGCAAGCAC GlyAsnAlaSerArgCysTrpValAlaMetThrProThrValAla
361  AGGGCAACGCCTCGAGTGTGTGGGTGGCGATGACCCCTACGGTGCC
     TCCCGTTGCGGAGCTCACAACCCACCGCTACTGGGGATGCCACCGG
```

```
       LysLysAsnLysArgAsnThrAsnArgArgProGlnAspValLysPheProGlyGlyGly
  1    AAAAAAAAACAAACAAGTAACACCAACCGTCGCCCACAGGACGTCAAGTTCCCGGGTGGCG
       TTTTTTTTTTGTTTGCATTGTGGTTGGCAGCGGGTGTCCTGCAGTTCAAGGGCCCACCGC

GlnIleValGlyGlyValTyrLeuLeuProArgGlyArgLeuGlyValArgAla
  61   GTCAGATCGTTGGTGGAGTTTACTTGTTGCCGCAGGGCCCTAGATTGGGTGTGCGCG
       CAGTCTAGCAACCACCTCAAATGAACAACGGCGTCCCGGGATCTAACCACACGC

ThrArgLysThrSerGluArgSerGlnProArgGlyArgArgGlnProIleProLysAla
  121  CGACGAGAAAGACTTCCGAGCGGTCGCAACCTCGAGGTAGACGCCAGCCTATCCCAAGG
       GCTGCTCTTTCTGAAGGCTCGCCAGCGTTGGAGCTCCATCTGCGGTCGGATAGGGTTCC

ArgArgProGluGlyArgThrTrpAlaGlnProGlyTyrTyrProLeuTyrProGlyAsn
  181  CTCGTCGGCCCGAGGGCAGGACCTGGCTCAGCCCGGTACCCTTGGCCCTCTATGGCA
       GAGCAGCCGGGCTCCCGTCCTGGACCCGAGTCGGGCCCATGGGAACCGGGAGATACCGT

GluGlyCysGlyTrpAlaGlyTrpLeuLeuSerProArgGlySerArgProSerTrpGly
  241  ATGAGGGCTGCGGGTGGGCGGGATGGCTCTCTGTCTCCCCGTGCTCTCGGCCTAGCTGGG
       TACTCCCGACGCCCACCCGCCCTACCGAGAGACAGAGGGCACCGAGAGCCGATCGACCC

ProThrAspProArgArgArgSerArgAsnLeuGlyLysValIleAspThrLeuThrCys
  301  GCCCACACAGACCCCGGGGCCTAGGTCGCGAACTTGGGTAAGGTCATCGATACCCTTACGT
       CGGGGTGTCTGGGGCCCGGATCCAGCGCGTTAAACCATTCCAGTAGCTATGGGAATGCA

GlyPheAlaAspLeuMetGlyTyrIleProLeuValGlyAlaProLeuGlyAlaAla
  361  GCGGCTTGCCGCCTGACCTCATGGGGTACATACCGCTCGTCGGCGCCCCTCTTGGAGGCGCTG
       CGCCGAAGCGGCTGGAGTACCCCATGTATGGCGAGCAGCCGCGGGGAGAACCTCCGGAC

-------overlap with CA216a-------
       ArgAlaLeuAlaHisGlyValArgValLeuGluAspGlyValAsnTyrAlaThrGlyAsn
  421  CCAGGGCCCTGGCGCATGGCCGTCCGGTTCTGGAAGACGGCGTGAACTATGCAACAGGA
       GGTCCCGGGACCGCGTACCGCAGGCCCAAGACCTTCTGCCGCACTTGATACGTTGTCCT LeuProGlyCysSerPheSerThrPhe
  481  ACCTTCCTGGTTGCTCTTTCTCTACCTTC
       TGGAAGGACCAACGAGAAAGAGATGGAAG
```

MetSerValValGlnProProGlyProProLeu
MetAlaLeuValOP

1   CGCAGAAAGCGTCTAGCCATGGCCGTTAGTAGTGTCTGCAGCCTCCAGGACCCCCC
    GCGTCTTTCGCAGATCGGTACCGGCAATCATCACAGACGTCGGAGGTCCTGGGGGG

ProGlyGluProAM

61  TCCCGGGAGAGCCATAGTGGTCTGCGGAACCGGTGAGTACACCGGAATTGCCAGGAGAC
    AGGGCCCTCTCGGTATCACCAGACGCCTTGGCCACTCATGTGGCCTTAACGGTCCTGCTG

MetProGlyAspLeuGlyValProProGlnAsp

121 CGGGTCCTTCTTGATCAACCCGCTCGAGATTTGGGCGTGCCCCGCAAGA
    GCCCAGGAAGAACCTAGTTGGGCGAGTTACGGACCTCTAAACCCGCACGGGGCGTTCT

CysAM                              OP  AM  GlyAlaCys
                                               *

181 CTGCTAGCCCGAGTAGTGTTGGGTCGCGAAAGGCCTTGTGGTACTGCCTGATAGGGTGCTT
    GACGATCGGGCTCATCACAACCCAGCGCTTTCCGGAACACCATGACGGACTATCCCACGAA

GluCysProGlyArgSerArgArgProCysThrMetSerThrAsnProLysProGlnLys

FIG. 58B

```
241  GCGAGTGCCCCGGGAGGTCTCGTAGACCGTGCACCATGAGCACGAATCCTAAACCTCAAA
     CGCTCACGGGGCCCTCCAGAGCATCTGGCACGTGGTACTCGTGCTTAGGATTTGGAGTTT
         LysAsnLysArgAsnThrAsnArgArgProGlnAspValLysPheProGlyGlyGlyGln

301  AAAAAAACAAACGTAACACCAACCGTCGCCCACAGGAGTCAAGTTCCCGGTGGCGGTC
     TTTTTTTGTTTGCATTGTGGTTGGCAGCGGGTGTCCTCAGTTCAAGGGCCACCGCCAG
         IleValGlyGlyValTyrLeuLeuProArgArgGlyProArgLeuGlyValArgAlaThr

361  AGATCGTTGGTGGAGTTTACTTGTTGCGCCAGGGCCCTAGATTGGTGTGCCGCGA
     TCTAGCAACCACTCAAATGAACACGCGGTCCCCGGATCTAACCACGCGGCT
         ArgLysThrSerGluArgSerGlnProArgGlyArgArgGlnProIleProLysAlaArg

421  CGAGAAAGACTTCCGAGCGGTCGCAACCTCGAGGTAGACGTCAGCCTATCCCCAAGGCTC
     GCTCTTTCTGAAGGCTCGCCAGCGTTGGAGCTCCATCTGCAGTCGGATAGGGGTTCCGAG
         ArgProGluGlyArgThrTrpAlaGlnProGlyTyrProTrpProLeuTyrGlyAsnGlu
```

```
                      ------overlap with CA290a------
481   GTCGGCCCGAGGGCAGGAGGACCTGGGCTCAGCCCGGGTACCCTTGGCCCCTCTATGGCAATG
      CAGCCGGGCTCCCGTCCCTGGACCCGAGTCGGGCCCATGGGAACCGGGGAGATACCGTTAC
            GlyCysGlyTrpAlaGlyTrpLeuLeuSerProArgGlySerArgProSerTrpGlyPro 541   AGGGCTGCGGGTGGGCGGGATGCTCCTGTCTCCCCGTGCTCTCGGCCTAGCTGGGCC
      TCCCGACGCCCACCCGCCCTACCGAGGACAGAGGGCACCGAGAGCCGGATCGACCCCGG
            ThrAspProArgArgSerArgAsnLeuGlyLysValIleAspThrLeuThrCysGly 601   CCACAGACCCCCGGCGGCGTAGGTCGCGCAATTTGGGTAAGGTCATCGATACCCTTACGTGCG
      GGTGTCTGGGGGCCGCCATCCAGCGCGTTAAACCCATTCCAGTAGCTATGGGAATGCACGC
            Phe

661   GCTTC
      CGAAG

* = Start of long HCV ORF
| = Putative first amino acid of large HCV polyprotein
# = Putative small encoded peptides (that may play a
    translational regulatory role)
```

```
    ValLeuGlyArgGluArgProCysGlyThrAlaOP AM GlyAlaCysGluCysProGly
  1 GTCTTGGGTCGCGAAAGGCCTTGTGTACTGCCTGATAGGGTGCTTGCGAGTGCCCCGGG
    CAGAACCCAGCGCTTTCCGAACCATGAGACGACTATCCCACGAACGCTCACGGGGCCC
                              *

ArgSerArgArgProCysThrMetSerThrAsnProLysPheProGlnArgLysThrLysArg
 61 AGGTCTCGTAGACCGTGCACGTGACCACCAATGAGCACGAATCTAAACCTCAAAGAAAAACCAAACGT
    TCCAGAGCATCTGGCACGTGTACTCGTGTTAGGATTTGGAGTTTCTTTTTGGTTTGCA

AsnThrAsnArgArgProGlnAspValLysPheProGlyGlyGlyGlnIleValGlyGly
121 AACACCAACCGTCGCCCACAGGACGTCAAGTTCCCGGGTGGCGGTCAGATCGTTGGTGGA
    TTGTGGTTGGCAGCGGGTGTCCTGCAGTTCAAGGGCCCACCGCCAGTCTAGCAACCACCT

ValTyrLeuLeuProArgArgGlyProArgLeuGlyValArgAlaThrArgLysThrSer
181 GTTTACTTGTTGCCGCGCAGGGCCCTAGATTGGGTGTGCGCGACGAGAAAGACTTCC
    CAAATGAACAACGGCGCGTCCCCGGGATCTAACCCACACGCGCTGCTCTTTCTGAAGG

----------overlap with CA290a----------
    GluArgSerGlnProArgGlyArgArgGlnProIleProLysAlaArgArgProGluGly
241 GAGCGGTCGCAACCTGCGAGGTAGACGTCAGCCTATCCCAAGGCTCGTCGGCCCGAGGGC
    CTCGCCAGCGTTGGAGCTCCATCTGCAGTCGGATAGGGGTTCCGAGCAGCCGGGCTCCCG ArgThrTrpAlaGlnProGlyTyrProTrpProLeuTyrGlyAsnGluGlyCys
301 AGGACCTGGGCTCAGCCCGGGTACCCTTGGCCCCTCTATGGCAATGAGGGCTGCG
    TCCTGGACCCGAGTCGGGCCCATGGGAACCGGGGAGATACCGTTACTCCCGACGC
           * = putative initiator methionine codon
```

FIG. 60

```
    #ProProOP
    #SerThrMetAsnHisSerProValArgAsnTyrCysLeuHisAlaGluSerValAM
    #LeuHisGluSerLeuProCysGluLeuLeuSerSerArgArgLysArgLeuAla
    CTCCACCATGAATCACTCCCCGTGAGGAACTACTGTCTTCACGCAGAAAGCGTCTAGCC
  1 GAGGTGGTACTTAGTGAGGGACACTCCTTGATGACAGAAGTGCGTCTTTCGCAGATCGG
                    #MetSerValValGlnProProGlyProProLeuProGlyGluProAM
    MetAlaLeuValOP
    ATGGCGTTAGTATGAGTGTCGTGCAGCCTCCAGGACCCCCTCCCGGAGAGCCATAGT
 61 TACCGCAATCATACTCACAGACGTCGGAGGTCCTGGGGGAGGGCCCTCGGTATCA
                                         ------overlap with ag30a------
    GGTCTGCGGAACCGGTGAGTACACCGGAATTGCCAGGACGACCGGGTCCTTTCTTGGATC
121 CCAGAGACGCCTTGGCCACTCATGTGGCCTTAACGGTCCTGCTGGCCCAGGAAAGAACCTAG
    #MetProGlyAspLeuGlyValProProGlnAspCysAM
    AACCCGCTCAATGCCTGGAGATTTGGGCGTGCCCCCCGCAAGACTGCTAGCCGAGTAGTGT
181 TTGGGCGAGTTACGACCTCTAAACCCGCACGGGGCGTTCTGACGATCGGCTCATCACA
                                    OP AM GlyAlaCysGluCysProGlyArgSer
                                              *
    TGGGTCGCGAAAGGCCTTGTGGTACTGCCTGATAGGTGCTTGCGAGTGCCCCGGAGGT
241 ACCCAGCGCTTTCCGGAACACCATGACGGACTATCCCACGAACGCTCACGGGCCCTCCA 301 CTCGTAGA
    GAGCATCT
                       ArgArg
```

\* = Start of long HCV ORF
\# = Putative small encoded peptides (that may play a translational regulatory role)

FIG. 61

```
-------Overlap with 15e-------
    GlyAlaCysTyrSerIleGluProLeuAspLeuProProIleIleGlnArgLeuHisGly
  1 GGGGCCTGCTACTTCCATAGAACCACTGGATCTACCTCCAATCATTCAAAGACTTCATGGC
    CCCCGGACGATGAAGGTATCTTGGTGACCTAGATGGAGGTTAGTAAGTTTCTGAAGGTACCG LeuSerAlaPheSerLeuHisSerTyrSerProGlyGluIleAsnArgValAlaAlaCys
 61 CTCAGCGCATTTCACTTCACACAGTTACTCTCCAGGTGAAATTAATAGGGTGGCCGCATGC
    GAGTCGCGTAAAAGTGAGTGTGTCAATGAGAGGTCCACTTTAATTATCCCACCGGCGTACG Gly*
                                                        G
    LeuArgLysLeuGlyValProProLeuArgAlaTrpArgHisArgAlaArgSerValArg
121 CTCAGAAAACTTGGGGTACCGCCCTTGCGAGCTGGAGACACCGGGCCCGGAGCGTCCGC
    GAGTCTTTTGAACCCCATGGCGGGAACGCTCGACCCTCGTGGCCCGGGCCTCGCAGGCG AlaArgLeuLeuAlaArgGlyGlyArgAlaAlaIleCysGlyLysTyrLeuPheAsnTrp
181 GCTAGGCTTCTGGCCAGAGGAGGCAGGGCTGCCATATGTGGCAAGTACCTCTTCAACTGG
    CGATCCGAAGACCGGTCTCCTCCGTCCCGACGGTATACACCGTTCATGGAGAAGTTGACC AlaValArgThrLysLeuLys
241 GCAGTAAGAACAAAGCTCAAAC
    CGTCATTCTTGTTTCGAGTTTG
```

* = nucleotide heterogeneity

FIG. 62A

```
CACTCCACCATGAATCACTCCCCTGTGAGGAACTACTGTCTTCACGCAGAAAGCGTCTAG
CCATGGCGTTAGTATGAGTGTCGTGCAGCCTCCAGGACCCCCCCTCCCGGGAGAGCCATA
GTGGTCTGCGGAACCGGTGAGTACACCGGAATTGCCAGGACGACCGGGTCCTTTCTTGGA
TCAACCCGCTCAATGCCTGGAGATTTGGGCGTGCCCCCGCAAGACTGCTAGCCGAGTAGT
GTTGGGTCGCGAAAGGCCTTGTGGTACTGCCTGATAGGGTGCTTGCGAGTGCCCCGGGAG-300
                    ---(Putative initiator methionine codon)
GTCTCGTAGACCGTGCACCATGAGCACGAATCCTAAACCTCAAAAAAAAAACAAACGTAA
CACCAACCGTCGCCCACAGGACGTCAAGTTCCCGGGTGGCGGTCAGATCGTTGGTGGAGT
TTACTTGTTGCCGCGCAGGGGCCCTAGATTGGGTGTGCGCGCGACGAGAAAGACTTCCGA
GCGGTCGCAACCTCGAGGTAGACGTCAGCCTATCCCCAAGGCTCGTCGGCCCGAGGGCAG
GACCTGGGCTCAGCCCGGGTACCCTTGGCCCCTCTATGGCAATGAGGGCTGCGGGTGGGC-600
GGGATGGCTCCTGTCTCCCCGTGGCTCTCGGCCTAGCTGGGGCCCCACAGACCCCCGGCG
TAGGTCGCGCAATTTGGGTAAGGTCATCGATACCCTTACGTGCGGCTTCGCCGACCTCAT
GGGGTACATACCGCTCGTCGGCGCCCTCTTGGAGGCGCTGCCAGGGCCCTGGCGCATGG
CGTCCGGGTTCTGGAAGACGGCGTGAACTATGCAACAGGGAACCTTCCTGGTTGCTCTTT
CTCTATCTTCCTTCTGGCCCTGCTCTCTTGCTTGACTGTGCCCGCTTCGGCCTACCAAGT-900
GCGCAACTCCACGGGGCTTTACCACGTCACCAATGATTGCCCTAACTCGAGTATTGTGTA
CGAGGCGGCCGATGCCATCCTGCACACTCCGGGGTGCGTCCCTTGCGTTCGTGAGGGCAA
CGCCTCGAGGTGTTGGGTGGCGATGACCCCTACGGTGGCCACCAGGGATGGCAAACTCCC
CGCGACGCAGCTTCGACGTCACATCGATCTGCTTGTCGGGAGCGCCACCCTCTGTTCGGC
CCTCTACGTGGGGGACCTATGCGGGTCTGTCTTTCTTGTCGGCCAACTGTTCACCTTCTC-1200
TCCCAGGCGCCACTGGACGACGCAAGGTTGCAATTGCTCTATCTATCCCGGCCATATAAC
GGGTCACCGCATGGCATGGGATATGATGATGAACTGGTCCCCTACGACGGCGTTGGTAAT
GGCTCAGCTGCTCCGGATCCCACAAGCCATCTTGGACATGATCGCTGGTGCTCACTGGGG
AGTCCTGGCGGGCATAGCGTATTTCTCCATGGTGGGGAACTGGGCGAAGGTCCTGGTAGT
GCTGCTGCTATTTGCCGGCGTCGACGCGGAAACCCACGTCACCGGGGGAAGTGCCGGCCA-1500
CACTGTGTCTGGATTTGTTAGCCTCCTCGCACCAGGCGCCAAGCAGAACGTCCAGCTGAT
CAACACCAACGGCAGTTGGCACCTCAATAGCACGGCCCTGAACTGCAATGATAGCCTCAA
CACCGGCTGGTTGGCAGGGCTTTTCTATCACCACAAGTTCAACTCTTCAGGCTGTCCTGA
GAGGCTAGCCAGCTGCCGACCCCTTACCGATTTTGACCAGGGCTGGGGCCCTATCAGTTA
TGCCAACGGAAGCGGCCCCGACCAGCGCCCCTACTGCTGGCACTACCCCCAAAACCTTG-1800
CGGTATTGTGCCCGCGAAGAGTGTGTGTGGTCCGGTATATTGCTTCACTCCCAGCCCCGT
GGTGGTGGGAACGACCGACAGGTCGGGCGCGCCCACCTACAGCTGGGGTGAAAATGATAC
GGACGTCTTCGTCCTTAACAATACCAGGCCACCGCTGGGCAATTGGTTCGGTTGTACCTG
GATGAACTCAACTGGATTCACCAAAGTGTGCGGAGCGCCTCCTTGTGTCATCGGAGGGGC
GGGCAACAACACCCTGCACTGCCCCACTGATTGCTTCCGCAAGCATCCGGACGCCACATA-2100
CTCTCGGTGCGGCTCCGGTCCCTGGATCACACCCAGGTGCCTGGTCGACTACCCGTATAG
GCTTTGGCATTATCCTTGTACCATCAACTACACCATATTTAAAATCAGGATGTACGTGGG
AGGGGTCGAACACAGGCTGGAAGCTGCCTGCAACTGGACGCGGGGCGAACGTTGCGATCT
GGAAGACAGGGACAGGTCCGAGCTCAGCCCGTTACTGCTGACCACTACACAGTGGCAGGT
CCTCCCGTGTTCCTTCACAACCCTACCAGCCTTGTCCACCGGCCTCATCCACCTCCACCA-2400
GAACATTGTGGACGTGCAGTACTTGTACGGGGTGGGGTCAAGCATCGCGTCCTGGGCCAT
TAACTGGGAGTACGTCGTTCTCCTGTTCCTTCTGCTTGCAGACGCGCGCGTCTGCTCCTG
CTTGTGGATGATGCTACTCATATCCCAAGCGGAGGCGGCTTTGGAGAACCTCGTAATACT
TAATGCAGCATCCCTGGCCGGGACGCACGGTCTTGTATCCTTCCTCGTGTTCTTCTGCTT
TGCATGGTATTTGAAGGGTAAGTGGGTGCCCGGAGCGGTCTACACCTTCTACGGGATGTG-2700
GCCTCTCCTCCTGCTCCTGTTGGCGTTGCCCCAGCGGGCGTACGCGCTGGACACGGAGGT
GGCCGCGTCGTGTGGCGGTGTTGTTCTCGTCGGGTTGATGGCGCTGACTCTGTCACCATA
TTACAAGCGCTATATCAGCTGGTGCTTGTGGTGGCTTCAGTATTTTCTGACCAGAGTGGA
AGCGCAACTGCACGTGTGGATTCCCCCCTCAACGTCCGAGGGGGGCGCGACGCCGTCAT
CTTACTCATGTGTGCTGTACACCCGACTCTGGTATTTGACATCACCAAATTGCTGCTGGC-3000
CGTCTTCGGACCCCTTTGGATTCTTCAAGCCAGTTTGCTTAAAGTACCCTACTTTGTGCG
CGTCCAAGGCCTTCTCCGGTTCTGCGCGTTAGCGCGGAAGATGATCGGAGGCCATTACGT
GCAAATGGTCATCATTAAGTTAGGGGCGCTTACTGGCACCTATGTTTATAACCATCTCAC
TCCTCTTCGGGACTGGGCGCACAACGGCTTGCGAGATCTGGCCGTGGCTGTAGAGCCAGT
CGTCTTCTCCCAAATGGAGACCAAGCTCATCACGTGGGGGGCAGATACCGCCGCGTGCGG-3300
TGACATCATCAACGGCTTGCCTGTTTCCGCCCGCAGGGGCCGGGAGATACTGCTCGGGCC
AGCCGATGGAATGGTCTCCAAGGGGTGGAGGTTGCTGGCGCCCATCACGGCGTACGCCCA
GCAGACAAGGGGCCTCCTAGGGTGCATAATCACCAGCCTAACTGGCCGGGACAAAAACCA
AGTGGAGGGTGAGGTCCAGATTGTGTCAACTGCTGCCCAAACCTTCCTGGCAACGTGCAT
```

FIG. 62B

```
CAATGGGGTGTGCTGGACTGTCTACCACGGGGCCGGAACGAGGACCATCGCGTCACCCAA-3600
GGGTCCTGTCATCCAGATGTATACCAATGTAGACCAAGACCTTGTGGGCTGGCCCGCTCC
GCAAGGTAGCCGCTCATTGACACCCTGCACTTGCGGCTCCTCGGACCTTTACCTGGTCAC
GAGGCACGCCGATGTCATTCCCGTGCGCCGGCGGGGTGATAGCAGGGGCAGCCTGCTGTC
GCCCCGGCCCATTTCCTACTTGAAAGGCTCCTCGGGGGGTCCGCTGTTGTGCCCCGCGGG
GCACGCCGTGGGCATATTTAGGGCCGCGGTGTGCACCCGTGGAGTGGCTAAGGCGGTGGA-3900
CTTTATCCCTGTGGAGAACCTAGAGACAACCATGAGGTCCCCGGTGTTCACGGATAACTC
CTCTCCACCAGTAGTGCCCCAGAGCTTCCAGGTGGCTCACCTCCATGCTCCCACAGGCAG
CGGCAAAAGCACCAAGGTCCCGGCTGCATATGCAGCTCAGGGCTATAAGGTGCTAGTACT
CAACCCCTCTGTTGCTGCAACACTGGGCTTTGGTGCTTACATGTCCAAGGCTCATGGGAT
CGATCCTAACATCAGGACCGGGGTGAGAACAATTACCACTGGCAGCCCCATCACGTACTC-4200
CACCTACGGCAAGTTCCTTGCCGACGGCGGGTGCTCGGGGGGCGCTTATGACATAATAAT
TTGTGACGAGTGCCACTCCACGGATGCCACATCCATCTTGGGCATCGGCACTGTCCTTGA
CCAAGCAGAGACTGCGGGGGCGAGACTGGTTGTGCTCGCCACCGCCACCCCTCCGGGCTC
CGTCACTGTGCCCCATCCCAACATCGAGGAGGTTGCTCTGTCCACCACCGGAGAGATCCC
TTTTTACGGCAAGGCTATCCCCCTCGAAGTAATCAAGGGGGGGAGACATCTCATCTTCTG-4500
TCATTCAAAGAAGAAGTGCGACGAACTCGCCGCAAAGCTGGTCGCATTGGGCATCAATGC
CGTGGCCTACTACCGCGGTCTTGACGTGTCCGTCATCCCGACCAGCGGCGATGTTGTCGT
CGTGGCAACCGATGCCCTCATGACCGGCTATACCGGCGACTTCGACTCGGTGATAGACTG
CAATACGTGTGTCACCCAGACAGTCGATTTCAGCCTTGACCCTACCTTCACCATTGAGAC
AATCACGCTCCCCCAGGATGCTGTCTCCCGCACTCAACGTCGGGGCAGGACTGGCAGGGG-4800
GAAGCCAGGCATCTACAGATTTGTGGCACCGGGGGAGCGCCCCTCCGGCATGTTCGACTC
GTCCGTCCTCTGTGAGTGCTATGACGCAGGCTGTGCTTGGTATGAGCTCACGCCCGCCGA
GACTACAGTTAGGCTACGAGCGTACATGAACACCCCGGGGCTTCCCGTGTGCCAGGACCA
TCTTGAATTTTGGGAGGGCGTCTTTACAGGCCTCACTCATATAGATGCCCACTTTCTATC
CCAGACAAAGCAGAGTGGGGAGAACCTTCCTTACCTGGTAGCGTACCAAGCCACCGTGTG-5100
CGCTAGGGCTCAAGCCCCTCCCCCATCGTGGGACCAGATGTGGAAGTGTTTGATTCGCCT
CAAGCCCACCCTCCATGGGCCAACACCCCTGCTATACAGACTGGGCGCTGTTCAGAATGA
AATCACCCTGACGCACCCAGTCACCAAATACATCATGACATGCATGTCGGCCGACCTGGA
GGTCGTCACGAGCACCTGGGTGCTCGTTGGCGGCGTCCTGGCTGCTTTGGCCGCGTATTG
CCTGTCAACAGGCTGCGTGGTCATAGTGGGCAGGGTCGTCTTGTCCGGGAAGCCGGCAAT-5400
CATACCTGACAGGGAAGTCCTCTACCGAGAGTTCGATGAGATGGAAGAGTGCTCTCAGCA
CTTACCGTACATCGAGCAAGGGATGATGCTCGCCGAGCAGTTCAAGCAGAAGGCCCTCGG
CCTCCTGCAGACCGCGTCCCGTCAGGCAGAGGTTATCGCCCCTGCTGTCCAGACCAACTG
GCAAAAACTCGAGACCTTCTGGGCGAAGCATATGTGGAACTTCATCAGTGGGATACAATA
CTTGGCGGGCTTGTCAACGCTGCCTGGTAACCCCGCCATTGCTTCATTGATGGCTTTTAC-5700
AGCTGCTGTCACCAGCCCACTAACCACTAGCCAAACCCTCCTCTTCAACATATTGGGGGG
GTGGGTGGCTGCCCAGCTCGCCGCCCCGGTGCCGCTACTGCCTTTGTGGGCGCTGGCTT
AGCTGGCGCCGCCATCGGCAGTGTTGGACTGGGGAAGGTCCTCATAGACATCCTTGCAGG
GTATGGCGCGGGCGTGGCGGGAGCTCTTGTGGCATTCAAGATCATGAGCGGTGAGGTCCC
CTCCACGGAGGACCTGGTCAATCTACTGCCCGCCATCCTCTCGCCCGGAGCCCTCGTAGT-6000
CGGCGTGGTCTGTGCAGCAATACTGCGCCGGCACGTTGGCCCGGGCGAGGGGGCAGTGCA
GTGGATGAACCGGCTGATAGCCTTCGCCTCCCGGGGGAACCATGTTTCCCCCACGCACTA
CGTGCCGGAGAGCGATGCAGCTGCCCGCGTCACTGCCATACTCAGCAGCCTCACTGTAAC
CCAGCTCCTGAGGCGACTGCACCAGTGGATAAGCTCGGAGTGTACCACTCCATGCTCCGG
TTCCTGGCTAAGGGACATCTGGGACTGGATATGCGAGGTGTTGAGCGACTTTAAGACCTG-6300
```

FIG. 62C

```
GCTAAAAGCTAAGCTCATGCCACAGCTGCCTGGGATCCCCTTTGTGTCCTGCCAGCGCGG
GTATAAGGGGGTCTGGCGAGTGGACGGCATCATGCACACTCGCTGCCACTGTGGAGCTGA
GATCACTGGACATGTCAAAAACGGGACGATGAGGATCGTCGGTCCTAGGACCTGCAGGAA
CATGTGGAGTGGGACCTTCCCCATTAATGCCTACACCACGGGCCCCTGTACCCCCCTTCC
TGCGCCGAACTACACGTTCGCGCTATGGAGGGTGTCTGCAGAGGAATATGTGGAGATAAG-6600
GCAGGTGGGGGACTTCCACTACGTGACGGGTATGACTACTGACAATCTCAAATGCCCGTG
CCAGGTCCCATCGCCCGAATTTTTCACAGAATTGGACGGGGTGCGCCTACATAGGTTTGC
GCCCCCTGCAAGCCCTTGCTGCGGGAGGAGGTATCATTCAGAGTAGGACTCCACGAATA
CCCGGTAGGGTCGCAATTACCTTGCGAGCCCGAACCGGACGTGGCCGTGTTGACGTCCAT
GCTCACTGATCCCTCCCATATAACAGCAGAGGCGGCCGGGCGAAGGTTGGCGAGGGGATC-6900
ACCCCCCTCTGTGGCCAGCTCCTCGGCTAGCCAGCTATCCGCTCCATCTCTCAAGGCAAC
TTGCACCGCTAACCATGACTCCCCTGATGCTGAGCTCATAGAGGCCAACCTCCTATGGAG
GCAGGAGATGGGCGGCAACATCACCAGGGTTGAGTCAGAAAACAAAGTGGTGATTCTGGA
CTCCTTCGATCCGCTTGTGGCGGAGGAGGACGAGCGGGAGATCTCCGTACCCGCAGAAAT
CCTGCGGAAGTCTCGGAGATTCGCCCAGGCCCTGCCCGTTTGGGCGCGGCCGGACTATAA-7200
CCCCCCGCTAGTGGAGACGTGGAAAAAGCCCGACTACGAACCACCTGTGGTCCATGGCTG
TCCGCTTCCACCTCCAAAGTCCCCTCCTGTGCCTCCGCCTCGGAAGAAGCGGACGGTGGT
CCTCACTGAATCAACCCTATCTACTGCCTTGGCCGAGCTCGCCACCAGAAGCTTTGGCAG
CTCCTCAACTTCCGGCATTACGGGCGACAATACGACAACATCCTCTGAGCCCGCCCCTTC
TGGCTGCCCCCCCGACTCCGACGCTGAGTCCTATTCCTCCATGCCCCCCCTGGAGGGGGA-7500
GCCTGGGGATCCGGATCTTAGCGACGGGTCATGGTCAACGGTCAGTAGTGAGGCCAACGC
GGAGGATGTCGTGTGCTGCTCAATGTCTTACTCTTGGACAGGCGCACTCGTCACCCCGTG
CGCCGCGGAAGAACAGAAACTGCCCATCAATGCACTAAGCAACTCGTTGCTACGTCACCA
CAATTTGGTGTATTCCACCACCTCACGCAGTGCTTGCCAAAGGCAGAAGAAAGTCACATT
TGACAGACTGCAAGTTCTGGACAGCCATTACCAGGACGTACTCAAGGAGGTTAAAGCAGC-7800
GGCGTCAAAAGTGAAGGCTAACTTGCTATCCGTAGAGGAAGCTTGCAGCCTGACGCCCCC
ACACTCAGCCAAATCCAAGTTTGGTTATGGGGCAAAAGACGTCCGTTGCCATGCCAGAAA
GGCCGTAACCCACATCAACTCCGTGTGGAAAGACCTTCTGGAAGACAATGTAACACCAAT
AGACACTACCATCATGGCTAAGAACGAGGTTTTCTGCGTTCAGCCTGAGAAGGGGGGTCG
TAAGCCAGCTCGTCTCATCGTGTTCCCCGATCTGGGCGTGCGCGTGTGCGAAAAGATGGC-8100
TTTGTACGACGTGGTTACAAAGCTCCCCTTGGCCGTGATGGGAAGCTCCTACGGATTCCA
ATACTCACCAGGACAGCGGGTTGAATTCCTCGTGCAAGCGTGGAAGTCCAAGAAAACCCC
AATGGGGTTCTCGTATGATACCCGCTGCTTTGACTCCACAGTCACTGAGAGCGACATCCG
TACGGAGGAGGCAATCTACCAATGTTGTGACCTCGACCCCCAAGCCCGCGTGGCCATCAA
GTCCCTCACCGAGAGGCTTTATGTTGGGGGCCCTCTTACCAATTCAAGGGGGGAGAACTG-8400
CGGCTATCGCAGGTGCCGCGCGAGCGGCGTACTGACAACTAGCTGTGGTAACACCCTCAC
TTGCTACATCAAGGCCCGGGCAGCCTGTCGAGCCGCAGGGCTCCAGGACTGCACCATGCT
CGTGTGTGGCGACGACTTAGTCGTTATCTGTGAAAGCGCGGGGGTCCAGGAGGACGCGGC
GAGCCTGAGAGCCTTCACGGAGGCTATGACCAGGTACTCCGCCCCCCTGGGGACCCCCC
ACAACCAGAATACGACTTGGAGCTCATAACATCATGCTCCTCCAACGTGTCAGTCGCCCA-8700
CGACGGCGCTGGAAAGAGGGTCTACTACCTCACCCGTGACCCTACAACCCCCCTCGCGAG
AGCTGCGTGGGAGACAGCAAGACACACTCCAGTCAATTCCTGGCTAGGCAACATAATCAT
GTTTGCCCCCACACTGTGGGCGAGGATGATACTGATGACCCATTTCTTTAGCGTCCTTAT
AGCCAGGGACCAGCTTGAACAGGCCCTCGATTGCGAGATCTACGGGGCCTGCTACTCCAT
AGAACCACTTGATCTACCTCCAATCATTCAAAGACTCCATGGCCTCAGCGCATTTTCACT-9000
CCACAGTTACTCTCCAGGTGAAATTAATAGGGTGGCCGCATGCCTCAGAAAACTTGGGGT
ACCGCCCTTGCGAGCTTGGAGACACCGGGCCCGGAGCGTCCGCGCTAGGCTTCTGGCCAG
AGGAGGCAGGGCTGCCATATGTGGCAAGTACCTCTTCAACTGGGCAGTAAGAACAAAGCT
CAAAC
```

FIG. 62D

```
   1 CACTCCACCATGAATCACTCCCCTGTGAGGAACTACTGTCTTCACGCAGAAAGCGTCTAG
     GTGAGGTGGTACTTAGTGAGGGGACACTCCTTGATGACAGAAGTGCGTCTTTCGCAGATC
  61 CCATGGCGTTAGTATGAGTGTCGTGCAGCCTCCAGGACCCCCCTCCCGGGAGAGCCATA
     GGTACCGCAATCATACTCACAGCACGTCGGAGGTCCTGGGGGGAGGGCCCTCTCGGTAT
 121 GTGGTCTGCGGAACCGGTGAGTACACCGGAATTGCCAGGACGACCGGGTCCTTTCTTGGA
     CACCAGACGCCTTGGCCACTCATGTGGCCTTAACGGTCCTGCTGGCCCAGGAAAGAACCT
 181 TCAACCCGCTCAATGCCTGGAGATTTGGGCGTGCCCCCGCAAGACTGCTAGCCGAGTAGT
     AGTTGGGCGAGTTACGGACCTCTAAACCCGCACGGGGGCGTTCTGACGATCGGCTCATCA
 241 GTTGGGTCGCGAAAGGCCTTGTGGTACTGCCTGATAGGGTGCTTGCGAGTGCCCCGGGAG
     CAACCCAGCGCTTTCCGGAACACCATGACGGACTATCCCACGAACGCTCACGGGGCCCTC
 301 GTCTCGTAGACCGTGCACCATGAGCACGAATCCTAAACCTCAAAAAAAAAACAAACGTAA
     CAGAGCATCTGGCACGTGGTACTCGTGCTTAGGATTTGGAGTTTTTTTTTGTTTGCATT
 361 CACCAACCGTCGCCCACAGGACGTCAAGTTCCCGGGTGGCGGTCAGATCGTTGGTGGAGT
     GTGGTTGGCAGCGGGTGTCCTGCAGTTCAAGGGCCCACCGCCAGTCTAGCAACCACCTCA
 421 TTACTTGTTGCCGCGCAGGGGCCCTAGATTGGGTGTGCGCGCGACGAGAAAGACTTCCGA
     AATGAACAACGGCGCGTCCCCGGGATCTAACCCACACGCGCGCTGCTCTTTCTGAAGGCT
 481 GCGGTCGCAACCTCGAGGTAGACGTCAGCCTATCCCCAAGGCTCGTCGGCCCGAGGGCAG
     CGCCAGCGTTGGAGCTCCATCTGCAGTCGGATAGGGGTTCCGAGCAGCCGGGCTCCCGTC
 541 GACCTGGGCTCAGCCCGGGTACCCTTGGCCCCTCTATGGCAATGAGGGCTGCGGGTGGGC
     CTGGACCCGAGTCGGGCCCATGGGAACCGGGGAGATACCGTTACTCCCGACGCCCACCCG
 601 GGGATGGCTCCTGTCTCCCCGTGGCTCTCGGCCTAGCTGGGGCCCCACAGACCCCCGGCG
     CCCTACCGAGGACAGAGGGGCACCGAGAGCCGGATCGACCCCGGGGTGTCTGGGGGCCGC
 661 TAGGTCGCGCAATTTGGGTAAGGTCATCGATACCCTTACGTGCGGCTTCGCCGACCTCAT
     ATCCAGCGCGTTAAACCCATTCCAGTAGCTATGGGAATGCACGCCGAAGCGGCTGGAGTA
 721 GGGGTACATACCGCTCGTCGGCGCCCTCTTGGAGGCGCTGCCAGGGCCCTGGCGCATGG
     CCCCATGTATGGCGAGCAGCCGCGGGGAGAACCTCCGCGACGGTCCCGGGACCGCGTACC
 781 CGTCCGGGTTCTGGAAGACGGCGTGAACTATGCAACAGGGAACCTTCCTGGTTGCTCTTT
     GCAGGCCCAAGACCTTCTGCCGCACTTGATACGTTGTCCCTTGGAAGGACCAACGAGAAA
 841 CTCTATCTTCCTTCTGGCCCTGCTCTCTTGCTTGACTGTGCCCGCTTCGGCCTACCAAGT
     GAGATAGAAGGAAGACCGGGACGAGAGAACGAACTGACACGGGCGAAGCCGGATGGTTCA
 901 GCGCAACTCCACGGGGCTTTACCACGTCACCAATGATTGCCCTAACTCGAGTATTGTGTA
     CGCGTTGAGGTGCCCCGAAATGGTGCAGTGGTTACTAACGGGATTGAGCTCATAACACAT
 961 CGAGGCGGCCGATGCCATCCTGCACACTCCGGGGTGCGTCCCTTGCGTTCGTGAGGGCAA
     GCTCCGCCGGCTACGGTAGGACGTGTGAGGCCCCACGCAGGGAACGCAAGCACTCCCGTT
1021 CGCCTCGAGGTGTTGGGTGGCGATGACCCCTACGGTGGCCACCAGGGATGGCAAACTCCC
     GCGGAGCTCCACAACCCACCGCTACTGGGGATGCCACCGGTGGTCCCTACCGTTTGAGGG
1081 CGCGACGCAGCTTCGACGTCACATCGATCTGCTTGTCGGGAGCGCCACCCTCTGTTCGGC
     GCGCTGCGTCGAAGCTGCAGTGTAGCTAGACGAACAGCCCTCGCGGTGGGAGACAAGCCG
1141 CCTCTACGTGGGGGACCTATGCGGGTCTGTCTTTCTTGTCGGCCAACTGTTCACCTTCTC
     GGAGATGCACCCCCTGGATACGCCCAGACAGAAAGAACAGCCGGTTGACAAGTGGAAGAG
1201 TCCCAGGCGCCACTGGACGACGCAAGGTTGCAATTGCTCTATCTATCCCGGCCATATAAC
     AGGGTCCGCGGTGACCTGCTGCGTTCCAACGTTAACGAGATAGATAGGGCCGGTATATTG
1261 GGGTCACCGCATGGCATGGGATATGATGATGAACTGGTCCCCTACGACGGCGTTGGTAAT
     CCCAGTGGCGTACCGTACCCTATACTACTACTTGACCAGGGGATGCTGCCGCAACCATTA
```

FIG. 62E

```
1321 GGCTCAGCTGCTCCGGATCCCACAAGCCATCTTGGACATGATCGCTGGTGCTCACTGGGG
     CCGAGTCGACGAGGCCTAGGGTGTTCGGTAGAACCTGTACTAGCGACCACGAGTGACCCC

1381 AGTCCTGGCGGGCATAGCGTATTTCTCCATGGTGGGGAACTGGGCGAAGGTCCTGGTAGT
     TCAGGACCGCCCGTATCGCATAAAGAGGTACCACCCCTTGACCCGCTTCCAGGACCATCA

1441 GCTGCTGCTATTTGCCGGCGTCGACGCGGAAACCCACGTCACCGGGGGAAGTGCCGGCCA
     CGACGACGATAAACGGCCGCAGCTGCGCCTTTGGGTGCAGTGGCCCCCTTCACGGCCGGT

1501 CACTGTGTCTGGATTTGTTAGCCTCCTCGCACCAGGCGCCAAGCAGAACGTCCAGCTGAT
     GTGACACAGACCTAAACAATCGGAGGAGCGTGGTCCGCGGTTCGTCTTGCAGGTCGACTA

1561 CAACACCAACGGCAGTTGGCACCTCAATAGCACGGCCCTGAACTGCAATGATAGCCTCAA
     GTTGTGGTTGCCGTCAACCGTGGAGTTATCGTGCCGGGACTTGACGTTACTATCGGAGTT

1621 CACCGGCTGGTTGGCAGGGCTTTTCTATCACCACAAGTTCAACTCTTCAGGCTGTCCTGA
     GTGGCCGACCAACCGTCCCGAAAAGATAGTGGTGTTCAAGTTGAGAAGTCCGACAGGACT

1681 GAGGCTAGCCAGCTGCCGACCCCTTACCGATTTTGACCAGGGCTGGGGCCCTATCAGTTA
     CTCCGATCGGTCGACGGCTGGGGAATGGCTAAAACTGGTCCCGACCCCGGGATAGTCAAT

1741 TGCCAACGGAAGCGGCCCCGACCAGCGCCCCTACTGCTGGCACTACCCCCCAAAACCTTG
     ACGGTTGCCTTCGCCGGGGCTGGTCGCGGGGATGACGACCGTGATGGGGGGTTTTGGAAC

1801 CGGTATTGTGCCCGCGAAGAGTGTGTGTGGTCCGGTATATTGCTTCACTCCCAGCCCCGT
     GCCATAACACGGGCGCTTCTCACACACACCAGGCCATATAACGAAGTGAGGGTCGGGGCA

1861 GGTGGTGGGAACGACCGACAGGTCGGGCGCGCCCACCTACAGCTGGGGTGAAAATGATAC
     CCACCACCCTTGCTGGCTGTCCAGCCCGCGCGGGTGGATGTCGACCCCACTTTTACTATG

1921 GGACGTCTTCGTCCTTAACAATACCAGGCCACCGCTGGGCAATTGGTTCGGTTGTACCTG
     CCTGCAGAAGCAGGAATTGTTATGGTCCGGTGGCGACCCGTTAACCAAGCCAACATGGAC

1981 GATGAACTCAACTGGATTCACCAAAGTGTGCGGAGCGCCTCCTTGTGTCATCGGAGGGGC
     CTACTTGAGTTGACCTAAGTGGTTTCACACGCCTCGCGGAGGAACACAGTAGCCTCCCCG

2041 GGGCAACAACACCCTGCACTGCCCCACTGATTGCTTCCGCAAGCATCCGGACGCCACATA
     CCCGTTGTTGTGGGACGTGACGGGGTGACTAACGAAGGCGTTCGTAGGCCTGCGGTGTAT

2101 CTCTCGGTGCGGCTCCGGTCCCTGGATCACACCCAGGTGCCTGGTCGACTACCCGTATAG
     GAGAGCCACGCCGAGGCCAGGGACCTAGTGTGGGTCCACGGACCAGCTGATGGGCATATC

2161 GCTTTGGCATTATCCTTGTACCATCAACTACACCATATTTAAAATCAGGATGTACGTGGG
     CGAAACCGTAATAGGAACATGGTAGTTGATGTGGTATAAATTTTAGTCCTACATGCACCC

2221 AGGGGTCGAACACAGGCTGGAAGCTGCCTGCAACTGGACGCGGGGCGAACGTTGCGATCT
     TCCCCAGCTTGTGTCCGACCTTCGACGGACGTTGACCTGCGCCCCGCTTGCAACGCTAGA

2281 GGAAGACAGGGACAGGTCCGAGCTCAGCCCGTTACTGCTGACCACTACACAGTGGCAGGT
     CCTTCTGTCCCTGTCCAGGCTCGAGTCGGGCAATGACGACTGGTGATGTGTCACCGTCCA

2341 CCTCCCGTGTTCCTTCACAACCCTACCAGCCTTGTCCACCGGCCTCATCCACCTCCACCA
     GGAGGGCACAAGGAAGTGTTGGGATGGTCGGAACAGGTGGCCGGAGTAGGTGGAGGTGGT

2401 GAACATTGTGGACGTGCAGTACTTGTACGGGGTGGGGTCAAGCATCGCGTCCTGGGCCAT
     CTTGTAACACCTGCACGTCATGAACATGCCCCACCCCAGTTCGTAGCGCAGGACCCGGTA

2461 TAAGTGGGAGTACGTCGTTCTCCTGTTCCTTCTGCTTGCAGACGCGCGCGTCTGCTCCTG
     ATTCACCCTCATGCAGCAAGAGGACAAGGAAGACGAACGTCTGCGCGCGCAGACGAGGAC

2521 CTTGTGGATGATGCTACTCATATCCCAAGCGGAGGCGGCTTTGGAGAACCTCGTAATACT
     GAACACCTACTACGATGAGTATAGGGTTCGCCTCCGCCGAAACCTCTTGGAGCATTATGA

2581 TAATGCAGCATCCCTGGCCGGGACGCACGGTCTTGTATCCTTCCTCGTGTTCTTCTGCTT
     ATTACGTCGTAGGGACCGGCCCTGCGTGCCAGAACATAGGAAGGAGCACAAGAAGACGAA
```

FIG. 62F

```
2641 TGCATGGTATTTGAAGGGTAAGTGGGTGCCCGGAGCGGTCTACACCTTCTACGGGATGTG
     ACGTACCATAAACTTCCCATTCACCCACGGGCCTCGCCAGATGTGGAAGATGCCCTACAC

2701 GCCTCTCCTCCTGCTCCTGTTGGCGTTGCCCCAGCGGGCGTACGCGCTGGACACGGAGGT
     CGGAGAGGAGGACGAGGACAACCGCAACGGGGTCGCCCGCATGCGCGACCTGTGCCTCCA

2761 GGCCGCGTCGTGTGGCGGTGTTGTTCTCGTCGGGTTGATGGCGCTGACTCTGTCACCATA
     CCGGCGCAGCACACCGCCACAACAAGAGCAGCCCAACTACCGCGACTGAGACAGTGGTAT

2821 TTACAAGCGCTATATCAGCTGGTGCTTGTGGTGGCTTCAGTATTTTCTGACCAGAGTGGA
     AATGTTCGCGATATAGTCGACCACGAACACCACCGAAGTCATAAAAGACTGGTCTCACCT

2881 AGCGCAACTGCACGTGTGGATTCCCCCCCTCAACGTCCGAGGGGGCGCGACGCCGTCAT
     TCGCGTTGACGTGCACACCTAAGGGGGGAGTTGCAGGCTCCCCCCGCGCTGCGGCAGTA

2941 CTTACTCATGTGTGCTGTACACCCGACTCTGGTATTTGACATCACCAAATTGCTGCTGGC
     GAATGAGTACACACGACATGTGGGCTGAGACCATAAACTGTAGTGGTTTAACGACGACCG

3001 CGTCTTCGGACCCCTTTGGATTCTTCAAGCCAGTTTGCTTAAAGTACCCTACTTTGTGCG
     GCAGAAGCCTGGGGAAACCTAAGAAGTTCGGTCAAACGAATTTCATGGGATGAAACACGC

3061 CGTCCAAGGCCTTCTCCGGTTCTGCGCGTTAGCGCGGAAGATGATCGGAGGCCATTACGT
     GCAGGTTCCGGAAGAGGCCAAGACGCGCAATCGCGCCTTCTACTAGCCTCCGGTAATGCA

3121 GCAAATGGTCATCATTAAGTTAGGGGCGCTTACTGGCACCTATGTTTATAACCATCTCAC
     CGTTTACCAGTAGTAATTCAATCCCCGCGAATGACCGTGGATACAAATATTGGTAGAGTG

3181 TCCTCTTCGGGACTGGGCGCACAACGGCTTGCGAGATCTGGCCGTGGCTGTAGAGCCAGT
     AGGAGAAGCCCTGACCCGCGTGTTGCCGAACGCTCTAGACCGGCACCGACATCTCGGTCA

3241 CGTCTTCTCCCAAATGGAGACCAAGCTCATCACGTGGGGGGCAGATACCGCCGCGTGCGG
     GCAGAAGAGGGTTTACCTCTGGTTCGAGTAGTGCACCCCCGTCTATGGCGGCGCACGCC

3301 TGACATCATCAACGGCTTGCCTGTTTCCGCCCGCAGGGGCCGGGAGATACTGCTCGGGCC
     ACTGTAGTAGTTGCCGAACGGACAAAGGCGGGCGTCCCCGGCCCTCTATGACGAGCCCGG

3361 AGCCGATGGAATGGTCTCCAAGGGGTGGAGGTTGCTGGCGCCCATCACGGCGTACGCCCA
     TCGGCTACCTTACCAGAGGTTCCCCACCTCCAACGACCGCGGGTAGTGCCGCATGCGGGT

3421 GCAGACAAGGGGCCTCCTAGGGTGCATAATCACCAGCCTAACTGGCCGGGACAAAAACCA
     CGTCTGTTCCCCGGAGGATCCCACGTATTAGTGGTCGGATTGACCGGCCCTGTTTTTGGT

3481 AGTGGAGGGTGAGGTCCAGATTGTGTCAACTGCTGCCCAAACCTTCCTGGCAACGTGCAT
     TCACCTCCCACTCCAGGTCTAACACAGTTGACGACGGGTTTGGAAGGACCGTTGCACGTA

3541 CAATGGGGTGTGCTGGACTGTCTACCACGGGGCCGGAACGAGGACCATCGCGTCACCCAA
     GTTACCCCACACGACCTGACAGATGGTGCCCCGGCCTTGCTCCTGGTAGCGCAGTGGGTT

3601 GGGTCCTGTCATCCAGATGTATACCAATGTAGACCAAGACCTTGTGGGCTGGCCCGCTCC
     CCCAGGACAGTAGGTCTACATATGGTTACATCTGGTTCTGGAACACCCGACCGGGCGAGG

3661 GCAAGGTAGCCGCTCATTGACACCCTGCACTTGCGGCTCCTCGGACCTTTACCTGGTCAC
     CGTTCCATCGGCGAGTAACTGTGGGACGTGAACGCCGAGGAGCCTGGAAATGGACCAGTG

3721 GAGGCACGCCGATGTCATTCCCGTGCGCCGGCGGGGTGATAGCAGGGGCAGCCTGCTGTC
     CTCCGTGCGGCTACAGTAAGGGCACGCGGCCGCCCCACTATCGTCCCGTCGGACGACAG

3781 GCCCCGGCCCATTTCCTACTTGAAAGGCTCCTCGGGGGGTCCGCTGTTGTGCCCCGCGGG
     CGGGGCCGGGTAAAGGATGAACTTTCCGAGGAGCCCCCAGGCGACAACACGGGGCGCCC

3841 GCACGCCGTGGGCATATTTAGGGCCGCGGTGTGCACCCGTGGAGTGGCTAAGGCGGTGGA
     CGTGCGGCACCCGTATAAATCCCGGCGCCACACGTGGGCACCTCACCGATTCCGCCACCT

3901 CTTTATCCCTGTGGAGAACCTAGAGACAACCATGAGGTCCCCGGTGTTCACGGATAACTC
     GAAATAGGGACACCTCTTGGATCTCTGTTGGTACTCCAGGGGCCACAAGTGCCTATTGAG
```

FIG. 62G

```
3961 CTCTCCACCAGTAGTGCCCCAGAGCTTCCAGGTGGCTCACCTCCATGCTCCCACAGGCAG
     GAGAGGTGGTCATCACGGGGTCTCGAAGGTCCACCGAGTGGAGGTACGAGGGTGTCCGTC

4021 CGGCAAAAGCACCAAGGTCCCGGCTGCATATGCAGCTCAGGGCTATAAGGTGCTAGTACT
     GCCGTTTTCGTGGTTCCAGGGCCGACGTATACGTCGAGTCCCGATATTCCACGATCATGA

4081 CAACCCCTCTGTTGCTGCAACACTGGGCTTTGGTGCTTACATGTCCAAGGCTCATGGGAT
     GTTGGGGAGACAACGACGTTGTGACCCGAAACCACGAATGTACAGGTTCCGAGTACCCTA

4141 CGATCCTAACATCAGGACCGGGGTGAGAACAATTACCACTGGCAGCCCCATCACGTACTC
     GCTAGGATTGTAGTCCTGGCCCCACTCTTGTTAATGGTGACCGTCGGGGTAGTGCATGAG

4201 CACCTACGGCAAGTTCCTTGCCGACGGCGGGTGCTCGGGGGGCGCTTATGACATAATAAT
     GTGGATGCCGTTCAAGGAACGGCTGCCGCCCACGAGCCCCCGCGAATACTGTATTATTA

4261 TTGTGACGAGTGCCACTCCACGGATGCCACATCCATCTTGGGCATCGGCACTGTCCTTGA
     AACACTGCTCACGGTGAGGTGCCTACGGTGTAGGTAGAACCCGTAGCCGTGACAGGAACT

4321 CCAAGCAGAGACTGCGGGGGCGAGACTGGTTGTGCTCGCCACCGCCACCCCTCCGGGCTC
     GGTTCGTCTCTGACGCCCCGCTCTGACCAACACGAGCGGTGGCGGTGGGGAGGCCCGAG

4381 CGTCACTGTGCCCCATCCCAACATCGAGGAGGTTGCTCTGTCCACCACCGGAGAGATCCC
     GCAGTGACACGGGGTAGGGTTGTAGCTCCTCCAACGAGACAGGTGGTGGCCTCTCTAGGG

4441 TTTTTACGGCAAGGCTATCCCCCTCGAAGTAATCAAGGGGGGGAGACATCTCATCTTCTG
     AAAAATGCCGTTCCGATAGGGGGAGCTTCATTAGTTCCCCCCCTCTGTAGAGTAGAAGAC

4501 TCATTCAAAGAAGAAGTGCGACGAACTCGCCGCAAAGCTGGTCGCATTGGGCATCAATGC
     AGTAAGTTTCTTCTTCACGCTGCTTGAGCGGCGTTTCGACCAGCGTAACCCGTAGTTACG

4561 CGTGGCCTACTACCGCGGTCTTGACGTGTCCGTCATCCCGACCAGCGGCGATGTTGTCGT
     GCACCGGATGATGGCGCCAGAACTGCACAGGCAGTAGGGCTGGTCGCCGCTACAACAGCA

4621 CGTGGCAACCGATGCCCTCATGACCGGCTATACCGGCGACTTCGACTCGGTGATAGACTG
     GCACCGTTGGCTACGGGAGTACTGGCCGATATGGCCGCTGAAGCTGAGCCACTATCTGAC

4681 CAATACGTGTGTCACCCAGACAGTCGATTTCAGCCTTGACCCTACCTTCACCATTGAGAC
     GTTATGCACACAGTGGGTCTGTCAGCTAAAGTCGGAACTGGGATGGAAGTGGTAACTCTG

4741 AATCACGCTCCCCCAGGATGCTGTCTCCCGCACTCAACGTCGGGGCAGGACTGGCAGGGG
     TTAGTGCGAGGGGGTCCTACGACAGAGGGCGTGAGTTGCAGCCCCGTCCTGACCGTCCCC

4801 GAAGCCAGGCATCTACAGATTTGTGGCACCGGGGGAGCGCCCCTCCGGCATGTTCGACTC
     CTTCGGTCCGTAGATGTCTAAACACCGTGGCCCCCTCGCGGGGAGGCCGTACAAGCTGAG

4861 GTCCGTCCTCTGTGAGTGCTATGACGCAGGCTGTGCTTGGTATGAGCTCACGCCCGCCGA
     CAGGCAGGAGACACTCACGATACTGCGTCCGACACGAACCATACTCGAGTGCGGGCGGCT

4921 GACTACAGTTAGGCTACGAGCGTACATGAACACCCCGGGGCTTCCCGTGTGCCAGGACCA
     CTGATGTCAATCCGATGCTCGCATGTACTTGTGGGCCCCGAAGGGCACACGGTCCTGGT

4981 TCTTGAATTTTGGGAGGGCGTCTTTACAGGCCTCACTCATATAGATGCCCACTTTCTATC
     AGAACTTAAAACCCTCCCGCAGAAATGTCCGGAGTGAGTATATCTACGGGTGAAAGATAG

5041 CCAGACAAAGCAGAGTGGGGAGAACCTTCCTTACCTGGTAGCGTACCAAGCCACCGTGTG
     GGTCTGTTTCGTCTCACCCCTCTTGGAAGGAATGGACCATCGCATGGTTCGGTGGCACAC

5101 CGCTAGGGCTCAAGCCCCTCCCCCATCGTGGGACCAGATGTGGAAGTGTTTGATTCGCCT
     GCGATCCCGAGTTCGGGGAGGGGGTAGCACCCTGGTCTACACCTTCACAAACTAAGCGGA

5161 CAAGCCCACCCTCCATGGGCCAACACCCCTGCTATACAGACTGGGCGCTGTTCAGAATGA
     GTTCGGGTGGGAGGTACCCGGTTGTGGGGACGATATGTCTGACCCGCGACAAGTCTTACT

5221 AATCACCCTGACGCACCCAGTCACCAAATACATCATGACATGCATGTCGGCCGACCTGGA
     TTAGTGGGACTGCGTGGGTCAGTGGTTTATGTAGTACTGTACGTACAGCCGGCTGGACCT
```

FIG. 62H

```
5281 GGTCGTCACGAGCACCTGGGTGCTCGTTGGCGGCGTCCTGGCTGCTTTGGCCGCGTATTG
     CCAGCAGTGCTCGTGGACCCACGAGCAACCGCCGCAGGACCGACGAAACCGGCGCATAAC

5341 CCTGTCAACAGGCTGCGTGGTCATAGTGGGCAGGGTCGTCTTGTCCGGGAAGCCGGCAAT
     GGACAGTTGTCCGACGCACCAGTATCACCCGTCCCAGCAGAACAGGCCCTTCGGCCGTTA

5401 CATACCTGACAGGGAAGTCCTCTACCGAGAGTTCGATGAGATGGAAGAGTGCTCTCAGCA
     GTATGGACTGTCCCTTCAGGAGATGGCTCTCAAGCTACTCTACCTTCTCACGAGAGTCGT

5461 CTTACCGTACATCGAGCAAGGGATGATGCTCGCCGAGCAGTTCAAGCAGAAGGCCCTCGG
     GAATGGCATGTAGCTCGTTCCCTACTACGAGCGGCTCGTCAAGTTCGTCTTCCGGGAGCC

5521 CCTCCTGCAGACCGCGTCCCGTCAGGCAGAGGTTATCGCCCCTGCTGTCCAGACCAACTG
     GGAGGACGTCTGGCGCAGGGCAGTCCGTCTCCAATAGCGGGGACGACAGGTCTGGTTGAC

5581 GCAAAAACTCGAGACCTTCTGGGCGAAGCATATGTGGAACTTCATCAGTGGGATACAATA
     CGTTTTTGAGCTCTGGAAGACCCGCTTCGTATACACCTTGAAGTAGTCACCCTATGTTAT

5641 CTTGGCGGGCTTGTCAACGCTGCCTGGTAACCCCGCCATTGCTTCATTGATGGCTTTTAC
     GAACCGCCCGAACAGTTGCGACGGACCATTGGGGCGGTAACGAAGTAACTACCGAAAATG

5701 AGCTGCTGTCACCAGCCCACTAACCACTAGCCAAACCCTCCTCTTCAACATATTGGGGGG
     TCGACGACAGTGGTCGGGTGATTGGTGATCGGTTTGGGAGGAGAAGTTGTATAACCCCCC

5761 GTGGGTGGCTGCCCAGCTCGCCGCCCCCGGTGCCGCTACTGCCTTTGTGGGCGCTGGCTT
     CACCCACCGACGGGTCGAGCGGCGGGGGCCACGGCGATGACGGAAACACCCGCGACCGAA

5821 AGCTGGCGCCGCCATCGGCAGTGTTGGACTGGGGAAGGTCCTCATAGACATCCTTGCAGG
     TCGACCGCGGCGGTAGCCGTCACAACCTGACCCCTTCCAGGAGTATCTGTAGGAACGTCC

5881 GTATGGCGCGGGCGTGGCGGGAGCTCTTGTGGCATTCAAGATCATGAGCGGTGAGGTCCC
     CATACCGCGCCCGCACCGCCCTCGAGAACACCGTAAGTTCTAGTACTCGCCACTCCAGGG

5941 CTCCACGGAGGACCTGGTCAATCTACTGCCCGCCATCCTCTCGCCCGGAGCCCTCGTAGT
     GAGGTGCCTCCTGGACCAGTTAGATGACGGGCGGTAGGAGAGCGGGCCTCGGGAGCATCA

6001 CGGCGTGGTCTGTGCAGCAATACTGCGCCGGCACGTTGGCCCGGGCGAGGGGGCAGTGCA
     GCCGCACCAGACACGTCGTTATGACGCGGCCGTGCAACCGGGCCCGCTCCCCCGTCACGT

6061 GTGGATGAACCGGCTGATAGCCTTCGCCTCCCGGGGGAACCATGTTTCCCCCACGCACTA
     CACCTACTTGGCCGACTATCGGAAGCGGAGGGCCCCCTTGGTACAAAGGGGGTGCGTGAT

6121 CGTGCCGGAGAGCGATGCAGCTGCCCGCGTCACTGCCATACTCAGCAGCCTCACTGTAAC
     GCACGGCCTCTCGCTACGTCGACGGGCGCAGTGACGGTATGAGTCGTCGGAGTGACATTG

6181 CCAGCTCCTGAGGCGACTGCACCAGTGGATAAGCTCGGAGTGTACCACTCCATGCTCCGG
     GGTCGAGGACTCCGCTGACGTGGTCACCTATTCGAGCCTCACATGGTGAGGTACGAGGCC

6241 TTCCTGGCTAAGGGACATCTGGGACTGGATATGCGAGGTGTTGAGCGACTTTAAGACCTG
     AAGGACCGATTCCCTGTAGACCCTGACCTATACGCTCCACAACTCGCTGAAATTCTGGAC

6301 GCTAAAAGCTAAGCTCATGCCACAGCTGCCTGGGATCCCCTTTGTGTCCTGCCAGCGCGG
     CGATTTTCGATTCGAGTACGGTGTCGACGGACCCTAGGGGAAACACAGGACGGTCGCGCC

6361 GTATAAGGGGGTCTGGCGAGTGGACGGCATCATGCACACTCGCTGCCACTGTGGAGCTGA
     CATATTCCCCCAGACCGCTCACCTGCCGTAGTACGTGTGAGCGACGGTGACACCTCGACT

6421 GATCACTGGACATGTCAAAAACGGGACGATGAGGATCGTCGGTCCTAGGACCTGCAGGAA
     CTAGTGACCTGTACAGTTTTTGCCCTGCTACTCCTAGCAGCCAGGATCCTGGACGTCCTT

6481 CATGTGGAGTGGGACCTTCCCCATTAATGCCTACACCACGGGCCCCTGTACCCCCCTTCC
     GTACACCTCACCCTGGAAGGGGTAATTACGGATGTGGTGCCCGGGGACATGGGGGGAAGG

6541 TGCGCCGAACTACACGTTCGCGCTATGGAGGGTGTCTGCAGAGGAATATGTGGAGATAAG
     ACGCGGCTTGATGTGCAAGCGCGATACCTCCCACAGACGTCTCCTTATACACCTCTATTC
```

FIG. 62I

```
6601 GCAGGTGGGGGACTTCCACTACGTGACGGGTATGACTACTGACAATCTCAAATGCCCGTG
     CGTCCACCCCCTGAAGGTGATGCACTGCCCATACTGATGACTGTTAGAGTTTACGGGCAC

6661 CCAGGTCCCATCGCCCGAATTTTTCACAGAATTGGACGGGGTGCGCCTACATAGGTTTGC
     GGTCCAGGGTAGCGGGCTTAAAAAGTGTCTTAACCTGCCCCACGCGGATGTATCCAAACG

6721 GCCCCCCTGCAAGCCCTTGCTGCGGGAGGAGGTATCATTCAGAGTAGGACTCCACGAATA
     CGGGGGGACGTTCGGGAACGACGCCCTCCTCCATAGTAAGTCTCATCCTGAGGTGCTTAT

6781 CCCGGTAGGGTCGCAATTACCTTGCGAGCCCGAACCGGACGTGGCCGTGTTGACGTCCAT
     GGGCCATCCCAGCGTTAATGGAACGCTCGGGCTTGGCCTGCACCGGCACAACTGCAGGTA

6841 GCTCACTGATCCCTCCCATATAACAGCAGAGGCGGCCGGGCGAAGGTTGGCGAGGGGATC
     CGAGTGACTAGGGAGGGTATATTGTCGTCTCCGCCGGCCCGCTTCCAACCGCTCCCCTAG

6901 ACCCCCCTCTGTGGCCAGCTCCTCGGCTAGCCAGCTATCCGCTCCATCTCTCAAGGCAAC
     TGGGGGGAGACACCGGTCGAGGAGCCGATCGGTCGATAGGCGAGGTAGAGAGTTCCGTTG

6961 TTGCACCGCTAACCATGACTCCCCTGATGCTGAGCTCATAGAGGCCAACCTCCTATGGAG
     AACGTGGCGATTGGTACTGAGGGGACTACGACTCGAGTATCTCCGGTTGGAGGATACCTC

7021 GCAGGAGATGGGCGGCAACATCACCAGGGTTGAGTCAGAAAACAAAGTGGTGATTCTGGA
     CGTCCTCTACCCGCCGTTGTAGTGGTCCCAACTCAGTCTTTTGTTTCACCACTAAGACCT

7081 CTCCTTCGATCCGCTTGTGGCGGAGGAGGACGAGCGGGAGATCTCCGTACCCGCAGAAAT
     GAGGAAGCTAGGCGAACACCGCCTCCTCCTGCTCGCCCTCTAGAGGCATGGGCGTCTTTA

7141 CCTGCGGAAGTCTCGGAGATTCGCCCAGGCCCTGCCCGTTTGGGCGCGGCCGGACTATAA
     GGACGCCTTCAGAGCCTCTAAGCGGGTCCGGGACGGGCAAACCCGCGCCGGCCTGATATT

7201 CCCCCCGCTAGTGGAGACGTGGAAAAAGCCCGACTACGAACCACCTGTGGTCCATGGCTG
     GGGGGGCGATCACCTCTGCACCTTTTTCGGGCTGATGCTTGGTGGACACCAGGTACCGAC

7261 TCCGCTTCCACCTCCAAAGTCCCCTCCTGTGCCTCCGCCTCGGAAGAAGCGGACGGTGGT
     AGGCGAAGGTGGAGGTTTCAGGGGAGGACACGGAGGCGGAGCCTTCTTCGCCTGCCACCA

7321 CCTCACTGAATCAACCCTATCTACTGCCTTGGCCGAGCTCGCCACCAGAAGCTTTGGCAG
     GGAGTGACTTAGTTGGGATAGATGACGGAACCGGCTCGAGCGGTGGTCTTCGAAACCGTC

7381 CTCCTCAACTTCCGGCATTACGGGCGACAATACGACAACATCCTCTGAGCCCGCCCCTTC
     GAGGAGTTGAAGGCCGTAATGCCCGCTGTTATGCTGTTGTAGGAGACTCGGGCGGGGAAG

7441 TGGCTGCCCCCCCGACTCCGACGCTGAGTCCTATTCCTCCATGCCCCCCCTGGAGGGGGA
     ACCGACGGGGGGGCTGAGGCTGCGACTCAGGATAAGGAGGTACGGGGGGGACCTCCCCCT

7501 GCCTGGGGATCCGGATCTTAGCGACGGGTCATGGTCAACGGTCAGTAGTGAGGCCAACGC
     CGGACCCCTAGGCCTAGAATCGCTGCCCAGTACCAGTTGCCAGTCATCACTCCGGTTGCG

7561 GGAGGATGTCGTGTGCTGCTCAATGTCTTACTCTTGGACAGGCGCACTCGTCACCCCGTG
     CCTCCTACAGCACACGACGAGTTACAGAATGAGAACCTGTCCGCGTGAGCAGTGGGGCAC

7621 CGCCGCGGAAGAACAGAAACTGCCCATCAATGCACTAAGCAACTCGTTGCTACGTCACCA
     GCGGCGCCTTCTTGTCTTTGACGGGTAGTTACGTGATTCGTTGAGCAACGATGCAGTGGT

7681 CAATTTGGTGTATTCCACCACCTCACGCAGTGCTTGCCAAAGGCAGAAGAAAGTCACATT
     GTTAAACCACATAAGGTGGTGGAGTGCGTCACGAACGGTTTCCGTCTTCTTTCAGTGTAA

7741 TGACAGACTGCAAGTTCTGGACAGCCATTACCAGGACGTACTCAAGGAGGTTAAAGCAGC
     ACTGTCTGACGTTCAAGACCTGTCGGTAATGGTCCTGCATGAGTTCCTCCAATTTCGTCG

7801 GGCGTCAAAAGTGAAGGCTAACTTGCTATCCGTAGAGGAAGCTTGCAGCCTGACGCCCCC
     CCGCAGTTTTCACTTCCGATTGAACGATAGGCATCTCCTTCGAACGTCGGACTGCGGGGG

7861 ACACTCAGCCAAATCCAAGTTTGGTTATGGGGCAAAAGACGTCCGTTGCCATGCCAGAAA
     TGTGAGTCGGTTTAGGTTCAAACCAATACCCCGTTTTCTGCAGGCAACGGTACGGTCTTT
```

FIG. 62J

```
7921  GGCCGTAACCCACATCAACTCCGTGTGGAAAGACCTTCTGGAAGACAATGTAACACCAAT
      CCGGCATTGGGTGTAGTTGAGGCACACCTTTCTGGAAGACCTTCTGTTACATTGTGGTTA

7981  AGACACTACCATCATGGCTAAGAACGAGGTTTTCTGCGTTCAGCCTGAGAAGGGGGGTCG
      TCTGTGATGGTAGTACCGATTCTTGCTCCAAAAGACGCAAGTCGGACTCTTCCCCCCAGC

8041  TAAGCCAGCTCGTCTCATCGTGTTCCCCGATCTGGGCGTGCGCGTGTGCGAAAAGATGGC
      ATTCGGTCGAGCAGAGTAGCACAAGGGGCTAGACCCGCACGCGCACACGCTTTTCTACCG

8101  TTTGTACGACGTGGTTACAAAGCTCCCCTTGGCCGTGATGGGAAGCTCCTACGGATTCCA
      AAACATGCTGCACCAATGTTTCGAGGGGAACCGGCACTACCCTTCGAGGATGCCTAAGGT

8161  ATACTCACCAGGACAGCGGGTTGAATTCCTCGTGCAAGCGTGGAAGTCCAAGAAAACCCC
      TATGAGTGGTCCTGTCGCCCAACTTAAGGAGCACGTTCGCACCTTCAGGTTCTTTTGGGG

8221  AATGGGGTTCTCGTATGATACCCGCTGCTTTGACTCCACAGTCACTGAGAGCGACATCCG
      TTACCCCAAGAGCATACTATGGGCGACGAAACTGAGGTGTCAGTGACTCTCGCTGTAGGC

8281  TACGGAGGAGGCAATCTACCAATGTTGTGACCTCGACCCCCAAGCCCGCGTGGCCATCAA
      ATGCCTCCTCCGTTAGATGGTTACAACACTGGAGCTGGGGGTTCGGGCGCACCGGTAGTT

8341  GTCCCTCACCGAGAGGCTTTATGTTGGGGGCCCTCTTACCAATTCAAGGGGGGAGAACTG
      CAGGGAGTGGCTCTCCGAAATACAACCCCGGGAGAATGGTTAAGTTCCCCCCTCTTGAC

8401  CGGCTATCGCAGGTGCCGCGCGAGCGGCGTACTGACAACTAGCTGTGGTAACACCCTCAC
      GCCGATAGCGTCCACGGCGCGCTCGCCGCATGACTGTTGATCGACACCATTGTGGGAGTG

8461  TTGCTACATCAAGGCCCGGGCAGCCTGTCGAGCCGCAGGGCTCCAGGACTGCACCATGCT
      AACGATGTAGTTCCGGGCCCGTCGGACAGCTCGGCGTCCCGAGGTCCTGACGTGGTACGA

8521  CGTGTGTGGCGACGACTTAGTCGTTATCTGTGAAAGCGCGGGGGTCCAGGAGGACGCGGC
      GCACACACCGCTGCTGAATCAGCAATAGACACTTTCGCGCCCCCAGGTCCTCCTGCGCCG

8581  GAGCCTGAGAGCCTTCACGGAGGCTATGACCAGGTACTCCGCCCCCCTGGGGACCCCCC
      CTCGGACTCTCGGAAGTGCCTCCGATACTGGTCCATGAGGCGGGGGGGACCCCTGGGGGG

8641  ACAACCAGAATACGACTTGGAGCTCATAACATCATGCTCCTCCAACGTGTCAGTCGCCCA
      TGTTGGTCTTATGCTGAACCTCGAGTATTGTAGTACGAGGAGGTTGCACAGTCAGCGGGT

8701  CGACGGCGCTGGAAAGAGGGTCTACTACCTCACCCGTGACCCTACAACCCCCCTCGCGAG
      GCTGCCGCGACCTTTCTCCCAGATGATGGAGTGGGCACTGGGATGTTGGGGGGAGCGCTC

8761  AGCTGCGTGGGAGACAGCAAGACACACTCCAGTCAATTCCTGGCTAGGCAACATAATCAT
      TCGACGCACCCTCTGTCGTTCTGTGTGAGGTCAGTTAAGGACCGATCCGTTGTATTAGTA

8821  GTTTGCCCCCACACTGTGGGCGAGGATGATACTGATGACCCATTTCTTTAGCGTCCTTAT
      CAAACGGGGGTGTGACACCCGCTCCTACTATGACTACTGGGTAAAGAAATCGCAGGAATA

8881  AGCCAGGGACCAGCTTGAACAGGCCCTCGATTGCGAGATCTACGGGGCCTGCTACTCCAT
      TCGGTCCCTGGTCGAACTTGTCCGGGAGCTAACGCTCTAGATGCCCCGGACGATGAGGTA

8941  AGAACCACTTGATCTACCTCCAATCATTCAAAGACTCCATGGCCTCAGCGCATTTTCACT
      TCTTGGTGAACTAGATGGAGGTTAGTAAGTTTCTGAGGTACCGGAGTCGCGTAAAAGTGA

9001  CCACAGTTACTCTCCAGGTGAAATTAATAGGGTGGCCGCATGCCTCAGAAAACTTGGGGT
      GGTGTCAATGAGAGGTCCACTTTAATTATCCCACCGGCGTACGGAGTCTTTTGAACCCCA

9061  ACCGCCCTTGCGAGCTTGGAGACACCGGGCCCGGAGCGTCCGCGCTAGGCTTCTGGCCAG
      TGGCGGGAACGCTCGAACCTCTGTGGCCCGGGCCTCGCAGGCGCGATCCGAAGACCGGTC

9121  AGGAGGCAGGGCTGCCATATGTGGCAAGTACCTCTTCAACTGGGCAGTAAGAACAAAGCT
      TCCTCCGTCCCGACGGTATACACCGTTCATGGAGAAGTTGACCCGTCATTCTTGTTTCGA

9181  CAAAC
      GTTTG
```

FIG. 65

| | EXPRESSION LEVEL | CHIMPS | | | CHRONIC HCV PATIENT C100 POSITIVE | | | | | | | | CHRONIC HCV PATIENT C100 NEGATIVE | | | | | | | | CONVALESCENT C100 NEGATIVE | COMMUNITY AC | | | | |
|---|---|---|---|---|---|---|---|---|---|---|---|---|---|---|---|---|---|---|---|---|---|---|---|---|---|---|
| | | 1. POST ACUTE | 2. POST ACUTE | 3. C100 CONVERSION | 1. | 2. | 3. | 4. | 5. | 6. | 7. | 8. | 1. | 2. | 3. | 4. | 5. | 6. | 7. | 8. | | 1. C100(+) | 2. C100(±) | 3. C100(−) | 4. C100(−) | 5. C100(−) |
| SOD | + | − | − | − | − | − | − | − | − | − | − | − | − | − | − | − | − | − | − | − | − | − | − | − | − | − |
| CA259a | | − | − | | | + | + | + | + | | | | | | | | | | | | + | | | | | |
| CA290a | | − | − | | | + | + | + | + | | | | | | | | | | | | + | | | | | |
| CA202a | N.T. | − | − | | | | | − | − | − | − | | | | | | | | | | − | | | | | |
| CA167a | + | − | − | − | − | − | − | − | − | − | − | − | − | − | − | − | − | − | − | − | − | − | − | − | − | − |
| CA156C | + | − | − | − | − | − | − | − | − | − | − | − | − | − | − | − | − | − | − | − | − | − | − | − | − | − |
| π14a | − | − | − | − | − | − | − | − | − | − | − | − | − | − | − | − | − | − | − | − | − | − | − | − | − | − |
| CA84a | ± | − | − | − | − | − | − | − | − | − | − | − | − | − | − | − | − | − | − | − | − | − | − | − | − | − |
| CA59a | − | − | − | − | − | − | − | − | − | − | − | − | − | − | − | − | − | − | − | − | − | − | − | − | − | − |
| CA61C | − | − | − | − | − | − | − | − | − | − | − | − | − | − | − | − | − | − | − | − | − | − | − | − | − | − |
| CA74a | + | − | − | − | − | − | − | + | − | − | − | − | − | − | − | − | − | − | − | − | − | − | − | − | − | − |
| C26j | + | − | − | − | − | − | − | − | − | − | − | − | − | − | − | − | − | − | − | − | − | − | − | − | − | − |
| C13i | ± | − | − | − | − | − | − | + | − | − | − | − | − | − | − | − | − | − | − | − | − | − | − | − | − | − |
| C12f | + | − | − | − | − | − | − | − | − | − | − | − | − | − | − | − | − | − | − | − | − | − | − | − | − | − |
| C14i | − | − | − | − | − | − | − | − | − | − | − | − | − | − | − | − | − | − | − | − | − | − | − | − | − | − |
| C23g | + | − | − | − | − | − | − | − | − | − | − | − | − | − | − | − | − | − | − | − | − | − | − | − | − | − |
| C11b | − | − | − | − | − | − | − | − | − | − | − | − | − | − | − | − | − | − | − | − | − | − | − | − | − | − |
| C9h | ± | − | − | − | − | − | − | − | − | − | − | − | − | − | − | − | − | − | − | − | − | − | − | − | − | − |
| C7f | − | − | − | − | − | − | − | − | − | − | − | − | − | − | − | − | − | − | − | − | − | − | − | − | − | − |
| C7e | + | − | − | − | − | − | − | − | − | − | − | − | − | − | − | − | − | − | − | − | − | − | − | − | − | − |
| C8h | + | − | − | − | − | − | − | − | − | − | − | − | − | − | − | − | − | − | − | − | − | − | − | − | − | − |
| C33c | + | + | ± | + | + | + | + | + | + | + | + | +† | + | + | + | + | + | + | − | − | − | ± | + | + | − | ± | − |
| C40g | ± | − | − | − | − | − | − | − | − | − | +† | − | − | − | − | − | − | − | − | − | − | − | − | − | − | − |
| C37b | + | − | − | − | − | − | − | − | − | − | − | − | − | − | − | − | − | − | − | − | − | − | − | − | − | − |
| C35 | ± | − | − | − | − | − | − | − | − | − | − | − | − | − | − | − | − | − | − | − | − | − | − | − | − | − |
| C36 | − | − | − | − | − | − | − | − | − | − | − | − | − | − | − | − | − | − | − | − | − | − | − | − | − | − |
| 5-1-1 | + | − | − | + | ± | + | + | + | + | + | + | − | − | − | − | + | + | + | + | − | + | + | − | + | ± | + | + | − |
| C81 | + | − | − | − | − | − | − | − | − | − | + | − | − | − | − | − | − | − | − | − | − | − | + | − | − | − |
| C32 | − | − | − | − | − | − | − | − | − | − | − | − | − | − | − | − | − | − | − | − | − | − | − | − | − | − |
| C33b | − | − | − | − | − | − | − | + | − | − | + | − | − | − | − | − | − | − | − | − | − | − | − | − | − | − |
| C25c | + | − | − | − | − | − | − | − | − | − | − | − | − | − | − | − | − | − | − | − | − | − | + | − | − | − |
| C14c | + | − | − | ± | − | − | − | − | − | − | − | − | + | − | + | − | − | − | − | − | + | − | + | − | − | − |
| C8f | ± | − | − | + | − | − | + | + | − | + | + | − | + | − | − | − | − | + | − | − | − | − | + | + | − | − |
| C33f | | − | − | − | − | + | + | − | − | − | + | − | + | − | − | − | − | − | − | + | + | − | − | + | − | − |
| C33g | ± | − | − | − | − | − | + | − | − | − | + | − | + | − | − | − | − | − | − | + | − | − | + | + | − | − |
| C39c | + | − | − | − | − | − | + | − | − | − | + | − | − | − | − | − | − | − | − | + | − | − | + | + | − | − |
| C35f | N.T. | − | − | − | − | − | − | − | − | − | − | − | − | − | − | − | − | − | − | − | − | − | − | − | − | − |
| C19g | + | − | − | − | − | − | − | − | − | − | − | − | − | − | − | − | − | − | − | − | − | − | − | − | − | − |
| C26g | + | − | − | − | − | − | − | − | − | − | − | − | − | − | − | − | − | − | − | − | − | − | − | − | − | − |
| C15c | ± | − | − | − | − | + | − | − | − | − | − | − | − | − | − | − | − | − | − | − | ± | − | − | − | − | − |

N.T. = EXPRESSION NOT TESTED  
† THIS POLYPEPTIDE WAS NEGATIVE IN THIS COLONY SCREEN BUT POSITIVE BY WESTERN BLOT ANALYSIS

FIG. 66A

```
         R T
MSTNPKPQKKNKRNTNRRPQDVKFPGGGQIVGGVYLLPRRGPRLGVRATR
KTSERSQPRGRRQPIPKARRPEGRTWAQPGYPWPLYGNEGCGWAGWLLSP-100
RGSRPSWGPTDPRRRSRNLGKVIDTLTCGFADLMGYIPLVGAPLGGAARA

T
LAHGVRVLEDGVNYATGNLPGCSFSIFLLALLSCLTVPASAYQVRNSTGL-200
YHVTNDCPNSSIVYEAADAILHTPGCVPCVREGNASRCWVAMTPTVATRD
GKLPATQLRRHIDLLVGSATLCSALYVGDLCGSVFLVGQLFTFSPRRHWT-300

V
TQGCNCSIYPGHITGHRMAWDMMMNWSPTTALVMAQLLRIPQAILDMIAG
AHWGVLAGIAYFSMVGNWAKVLVVLLLFAGVDAETHVTGGSAGHTVSGFV-400
SLLAPGAKQNVQLINTNGSWHLNSTALNCNDSLNTGWLAGLFYHHKFNSS
GCPERLASCRPLTDFDQGWGPISYANGSGPDQRPYCWHYPPKPCGIVPAK-500
SVCGPVYCFTPSPVVVGTTDRSGAPTYSWGENDTDVFVLNNTRPPLGNWF
GCTWMNSTGFTKVCGAPPCVIGGAGNNTLHCPTDCFRKHPDATYSRCGSG-600

I
PWLTPRCLVDYPYRLWHYPCTINYTIFKIRMYVGGVEHRLEAACNWTRGE
RCDLEDRDRSELSPLLLTTTQWQVLPCSFTTLPALSTGLIHLHQNIVDVQ-700
YLYGVGSSIASWAIKWEYVVLLFLLLADARVCSCLWMMLLISQAEAALEN
LVILNAASLAGTHGLVSFLVFFCFAWYLKGKWVPGAVYTFYGMWPLLLLL-800

(N)
LALPQRAYALDTEVAASCGGVVLVGLMALTLSPYYKRYISWCLWWLQYFL
TRVEAQLHVWIPPLNVRGGRDAVILLMCAVHPTLVFDITKLLLAVFGPLN-900
ILQASLLKVPYFVRVQGLLRFCALARKMIGGHYVQMVIIKLGALTGTYVY
NHLTPLRDWAHNGLRDLAVAVEFVVFSQMETKLITWGADTAACGDIINGL-1000
PVSARRGREILLGPADGMVSKGWRLLAPITAYAQQTRGLLGCIITSLTGR
DKNQVEGEVQIVSTAAQTTFATCINGVCWTVYHGAGTRTIASPKGPVIQM-1100
YTNVDQDLVGWPAPQGSRSLTPCTCGSSDLYLVTRHADVIPVRRRGDSRG
SLLSPRPISYLKGSSGGPLLCPAGHAVGIFRAAVCTRGVAKAVDFIPVEN-1200
LETTMRSPVFTDNSSPPVVPQSFQVAHLHAPTGSGKSTKVPAAYAAQGYK

L
VLVLNPSVAATLGFGAYMSKAHGIDPNIRTGVRTITTGSPITYSTYGKFL-1300

ADGGCSGGAYDIIICDECHSTDATSILGIGTVLDQAETAGARLVVLATAT
PPGSVTVPHPNIEEVALSTTGEIPFYGKAIPLEVIKGGRHLIFCHSKKKC-1400
DELAAKLVALGINAVAYYRGLDVSVIPTSGDVVVVATDALMTGYTGDFDS

Y          (S)
VIDCNTCVTQTVDFSLDPTFTIETITLPQDAVSRTQRRGRTGRGKPGIYR-1500
FVAPGERPSGMFDSSVLCECYDAGCAWYELTPAETTVRLRAYMNTPGLPV
CQDHLEFWEGVFTGLTHIDAHFLSQTKQSGENLPYLVAYQATVCARAQAP-1600
PPSWDQMWKCLIRLKPTLHGPTPLLYRLGAVQNEITLTHPVTKYIMTCMS
ADLEVVTSTWVLVGGVLAALAAYCLSTGCVVIVGRVVLSGKPAIIPDREV-1700
LYREFDEMEECSQHLPYIEQGMMLAEQFKQKALGLLQTASRQAEVIAPAV
QTNWQKLETFWAKHMWNFISGIQYLAGLSTLPGNPAIASLMAFTAAVTSP-1800
LTTSQTLLFNILGGWVAAQLAAPGAATAFVGAGLAGAAIGSVGLGKVLID
```

FIG. 66B

```
                              (G)
ILAGYGAGVAGALVAFKIMSGEVPSTEDLVNLLPAILSPGALVVGVVCAA-1900

(HC)
ILRRHVGPGEGAVQWMNRLIAFASRGNHVSPTHYVPESDAAARVTAILSS
LTVTQLLRRLHQWISSECTTPCSGSWLRDIWDWICEVLSDFKTWLKAKLM-2000

(V)
PQLPGIPFVSCQRGYKGVWRGDGIMHTRCHCGAEITGHVKNGTMRIVGPR
TCRNMWSGTFPINAYTTGPCTPLPAPNYTFALWRVSAEEYVEIRQVGDFH-2100
YVTGMTTDNLKCPCQVPSPEFFTELDGVRLHRFAPPCKPLLREEVSFRVG
LHEYPVGSQLPCEPEPDVAVLTSMLTDPSHITAEAAGRRLARGSPPSVAS-2200
SSASQLSAPSLKATCTANHDSPDAELIEANLLWRQEMGGNITRVESENKV
VILDSFDPLVAEEDEREISVPAEILRKSRRFAQALPVWARPDYNPPLVET-2300

S
WKKPDYEPPVVHGCPLPPPKSPPVPPPRKKRTVVLTESTLSTALAELATR (FA)
SFGSSSTSGITGDNTTTSSEPAPSGCPPDSDAESYSSMPPLEGEPGDPDL-2400
SDGSWSTVSSEANAEDVVCCSMSYSWTGALVTPCAAEEQKLPINALSNSL
LRHHNLVYSTTSRSACQRQKKVTFDRLQVLDSHYQDVLKEVKAAASKVKA-2500
(F)
NLLSVEEACSLTPPHSAKSKFGYGAKDVRCHARKAVTHINSVWKDLLEDN
VTPIDTTIMAKNEVFCVQPEKGGRKPARLIVFPDLGVRVCEKMALYDVVT-2600
KLPLAVMGSSYGFQYSPGQRVEFLVQAWKSKKTPMGFSYDTRCFDSTVTE (G)
SDIRTEEAIYQCCDLDPQARVAIKSLTERLYVGGPLTNSRGENCGYRRCR-2700
ASGVLTTSCGNTLTCYIKARAACRAAGLQDCTMLVCGDDLVVICESAGVQ
EDAASLRAFTEAMTRYSAPPGDPPQPEYDLELITSCSSNVSVAHDGAGKR-2800
VYYLTRDPTTPLARAAWETARHTFVNSWLGNIIMFAPTLWARMILMTHFF
SVLIARDQLEQALDCEIYGACYSIEPLDLPPIIQRLHGLSAFSLHSYSPG-2900

G
EINRVAACLRKLGVPPLRAWRHRARSVRARLLARGGRAAICGKYLFNWAV
RTKLK--------------(Stop codon not yet reached)
```

( ) = Heterogeneity due to possible 5' or 3' terminal cloning artefacts.

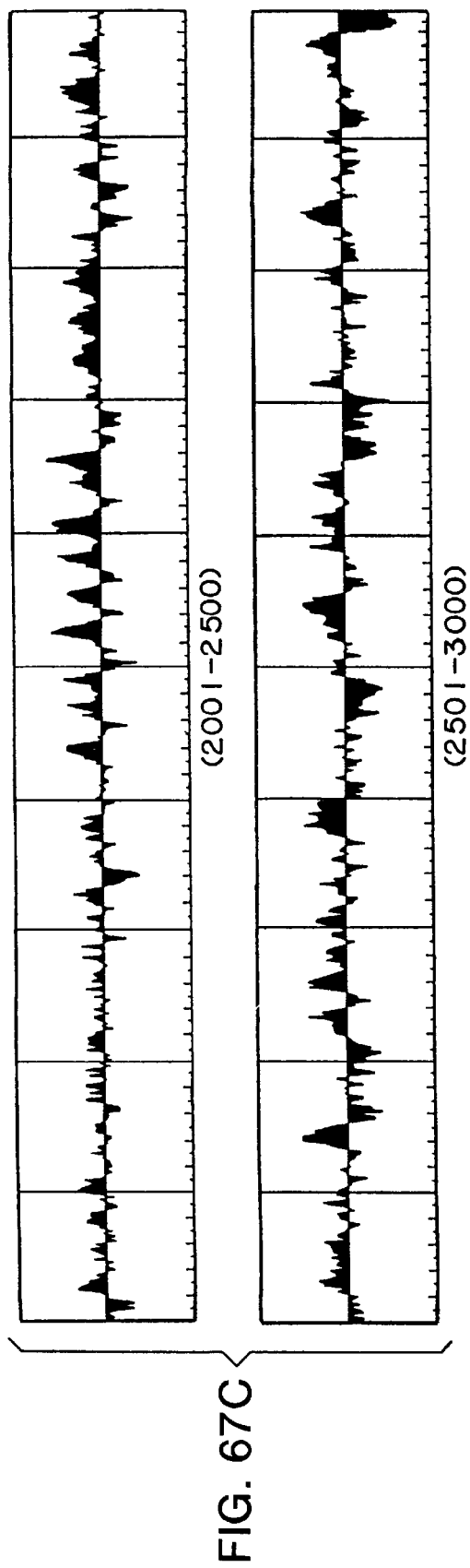
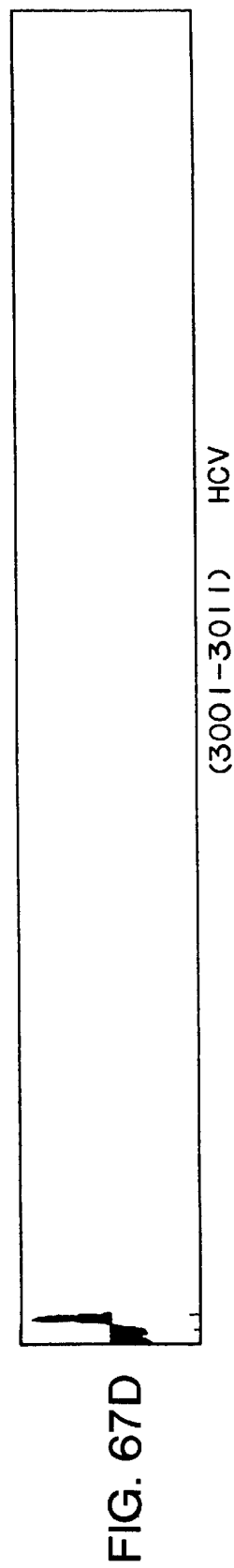
FIG. 67C
FIG. 67D

FIG. 68

```
                                                           NS5
                                                    Highly-conserved
                                                        Polymerase
                     NS3 region                           region Flaviviruses      TATPPG---------SAAQRRGRIGRNP----  ------------GDDCVV
(Yellow Fever,
West Nile,Dengue) ******        *  *****  **                    *** **

HCV               TATPPG---------SRTQRRGRTGRGK----  ------------GDDLVV
                     |              |                              |
                   #1348          #1483                          #2737
```

FIG. 73

```
5'                                                              3'
CCGGGCGAGGGGGCAGTGCAGTGGATGAACCGGCTGATAGCCTTCGCCTCCCGGGGGAAC
  CGCTCCCCCGTCACGTCACCTACTTGGCCGACTATCGGAAGCGGAGGGCCCCCTTG
3'                                                              5'

5'                     3'
CATGTTTCCCCCTAATGAG
GTACAAAGGGGGATTACTCAGC
3'                      5'
```

FIG. 71

```
------------------Overlap with 16jh-------------------
  GlyArgAlaAlaIleCysGlyLysTyrLeuPheAsnTrpAlaValArgThrLysLeuLys
1 GGCAGGCTGCCATATGTGGCAAGTACCCTCTCAACTGGGCAGTAAGAACAAAGCTCAAA
  CCGTCCCGACGGTATACACCGTTCATGGAGAAGTTGACCCGTCATTCTTGTTTCGAGTTT
  -
    LeuThrProIleAlaAlaAlaGlyGlnLeuAspLeuSerGlyTrpPheThrAlaGlyTyr
61  CTCACTCCAATAGCGGCGGCCGGCCAGCTGGACTTGTCCGGCTGGTTCACGGCTGGCTAC
    GAGTGAGGTTATCGCCGCCGGCCGGTCGACCTGAACAGGCCGACCAAGTGCCGACCGATG
     SerGlyGlyAspIleTyrHisSerValSerHisAlaArgProArgTrpIleTrpPheCys
121  AGCGGGGGAGACATTTATCACAGCGTGTCTCATGCCCCGCCTGGATCTGGTTTTGC
     TCGCCCCCTCTGTAAATAGTGTCGCACAGAGTACGGGGCCGGACCTAGACCAAAACG
181  CC
     GG
```

FIG. 72A

```
   MetSerThrAsnProLysProGlnArgLysThrLysArgAsnThrArgArgProGln
1  ATGAGCACGAATCCTAAACCTCAAAGAAAAAACAAACGTAACACCAACCGTCGCCACAG
   TACTCGTGCTTAGGATTTGGAGTTTTTTTGTTTGCATTGTGGTTGGCAGCGGGTGTC

AspValLysPheProGlyGlyGlyGlnIleValGlyGlyValTyrLeuLeuProArgArg
61 GACGTCAAGTTCCCGGGTGGCGGTCAGATCGTTGGTGGAGTTTACTTGTTGCCGCAGG
   CTGCAGTTCAAGGGCCCACCGCCAGTCTAGCAACCACCTCAAATGAACAACGGCGGTCC
```

FIG. 72B

```
       GlyProArgLeuGlyValArgAlaThrArgLysThrSerGluArgSerGlnProArgGly
121    GGCCCTAGATTGGGTGTGCGCGACGGCGCGAGAAAGACTTCCGAGCGGTCGCAACCTGAGGT
       CCGGGATCTAACCCACACGCGCTGCCGCGCTCTTTCTGAAGGCTCGCCAGCGTTGGAGCTCCA

ArgArgGlnProIleProLysAlaArgArgProGluGlyArgThrTrpAlaGlnProGly
181    AGACGTCAGCCTATCCCCAAGGCTCGTCGGCCCGAGGACAGGACCTGGGCTCAGCCCGGG
       TCTGCAGTCGGATAGGGGTTCCGAGCAGCCGGGCTCCCGTCCTGGACCCGAGTCGGGCCC

TyrProTrpProLeuTyrGlyAsnGluGlyCysGlyTrpAlaGlyTrpLeuLeuSerPro
241    TACCCTTGGCCCCTCTATGGCAATGAGGGCTGCGGGTGGGCGGGATGGCTCCTGTCTCCC
       ATGGGAACCGGGGAGATACCGTTACTCCCGACGCCCACCCGCCCTACCGAGGACAGAGGG

ArgGlySerArgProSerTrpGlyProThrAspProArgArgSerArgArgAsnLeuGly
301    CGTGGCTCTCGGCCCTAGCTGGGGCCCCACAGACCCCCGGCTAGGTCGCGCAATTTGGGT
       GCACCGAGAGCCGGGATCGACCCCGGGGTGTCTGGGGCCGATCCAGCGCGTTAAACCCA

LysValIleAspThrLeuThrCysGlyPheAlaAspLeuMetGlyTyrIleProLeuVal
361    AAGGTCATCGATACCCTTACGTGCGGCTTCGCCGACCTCATGGGCTACATACCGCTCGTC
       TTCCAGTAGCTATGGGAATGCACGCCGAAGCGGCTGGAGTACCCATGTATGGCGAGCAG

GlyAlaProLeuGlyGlyAlaAlaArgAlaLeuAlaHisGlyValArgValLeuGluAsp
421    GGCGCCCCTCTTGGAGGCGCTGCCAGGGCCCTGGCGCATGGCGTCCGGGTTCTGGAAGAC
       CCGCGGGGAGAACCTCCGCGACGGTCCCGGGACCGCGTACCGCAGGCCCAAGACCTTCTG
```

FIG. 72C

```
     GlyValAsnTyrAlaThrGlyAsnLeuProGlyCysSerPheSerIlePheLeuLeuAla
     GGCGTGAACTATGCAACAGGGAACCTTCCTGGTTGTGCTTCTTCTATCTTCCTTCTGGCC
481  CCGCACTTGATACGTTGTCCCTTGGAAGGACCAACGAGAAGATAGAAGGAAGACCGG

LeuLeuSerCysLeuThrValProAlaSerAlaTyrGlnValArgAsnSerThrGlyLeu
     CTGCTCTCTTGTCTTGACTGTGCCCGCTTCGGCCTACCAAGTGCGCAACTCCACGGGCTT
541  GACGAGAGAACGAACTGACACGGGCGAAGCCGGATGGTTCACGCGTTGAGGTGCCCGAA

TyrHisValThrAsnAspCysProAsnSerSerIleValTyrGluAlaAlaAspAlaIle
     TACCACGTCACCAATGATTGCCCTAACTCGAGTATTGTGTACGAGGGCGATGCCATC
601  ATGGTGCAGTGGTTACTAACGGATTGAGCTCATAACACATGCTCCGCCGCTACGGTAG

LeuHisThrProGlyCysValProCysValArgGluGlyAsnAlaSerArgCysTrpVal
     CTGCACACTCCGGGCTGTGTGCCTTGCGTTCGTGAGGGCAACGCCTCGAGTGTTGGGTG
661  GACGTGTGAGGCCCCACGCACACGGAACGCAAGCACTCCCGTTGCGGAGCTCCACAACCAC

AlaMetThrProThrValAlaThrArgAspGlyLysLeuProAlaThrGlnLeuArgArg
     GCGATGACCCCTACGGTGGCCACCAGGGATGGCAAACTCCCCGCGACGCAGCTTCGACGT
721  CGCTACTGGGGATGCCACCGGTGGTCCCTACCGTTTGAGGGGCGCTGCGTCGAAGCTGCA

HisIleAspLeuLeuValGlySerAlaThrLeuCysSerAlaLeuTyrValGlyAspLeu
     CACATCGATCTGCTTGTCGGGAGCGCCACCCTCTGTTCGGCCCTCTACGTGGGGGACCTG
781  GTGTAGCTAGACGAACAGCCCTCGCGGTGGGAGACAAGCCGGGAGATGCACCCCCTGGAC

CysGlySerValPheLeuValGlyGlnLeuPheThrPheSerProArgArgHisTrpThr
     TGCGGGTCTGTCTTTCTTGTCGGCCAACTGTTCACCTTCTCCCAGGCGCCACTGGACG
841  ACGCCCAGAGACAGAAAGAACAGAAGAACAGCCGGTTGACAAGTGGAAGAGAGGGTCCGGTGACCTGC
```

FIG. 72D

```
     ThrGlnGlyCysAsnCysSerIleTyrProGlyHisIleThrGlyHisArgMetAlaTrp
901  ACGCAAGGTTGCAATTGCTCTATCTATCCCGGCCATATAACGGTCACCGGTCATGGCATGG
     TGCGTTCCAACGTTAACGAGATAGATAGGGCCGGTATATTGCCAGTGGCCAGTACCGTACC

AspMetMetMetAsnTrpSerProThrThrAlaLeuValMetAlaGlnLeuLeuArgIle
961  GATATGATGATGAACTGGTCCCCTACGACGGCGTTGGTAATGGCTCAGCTGCTCCGGATC
     CTATACTACTACTTGACCAGGGGATGCTGCCGCAACCATTACCGAGTCGACGAGGCCTAG

ProGlnAlaIleLeuAspMetIleAlaGlyAlaAlaHisTrpGlyValLeuAlaGlyIleAlaAla
1021 CCACAAGCCATCTTGGACATGATCGCTGGTGCTCACTGGGGAGTCCTGGCGGGCATAGCG
     GGTGTTCGGTAGAACCTGTACTAGCGACCACGAGTGACCCCTCAGGACCGCCCGTATCGC

TyrPheSerMetValGlyAsnTrpAlaAlaLysValThrGlyHisThrValSerGlyPheValGly
1081 TATTTCTCCATGGTGGGAAACTGGGCGGCGAAGGTCCTGGTAGTGCTGCTGCTATTGCCGGC
     ATAAAGAGGTACCACCCCTTGACCCGCCGCTTCCAGGACCATCACGACGACGATAAACGGCCG

ValAspAlaGluThrHisValThrGlyGlySerAlaGlyHisValThrGlyGlySerAlaGlyHisValThrValSerGlyPheVal
1141 GTCGACGCGGGAAACCCACGTCACCGGGGGAAGTGCCGGCCACACTGTCTGGATTTGTT
     CAGCTGCGCCCTTTGGGTGCAGTGGCCCCCTTCACGGCCGGTGTGACACAGACCTAAACAA

SerLeuLeuAlaProGlyAlaAlaLysGlnAsnValGlnLeuIleAsnThrAsnGlySerTrp
1201 AGCCCTCCGCACCAGGCGCCAAGCGCCAGAACGTCCAGCTGATCAACACCAACGGCAGTTGG
     TCGGGAGGAGCCGTGGTCCGCGGTTCGTCTTGCAGGTCGACTAGTTGTTGCCGTCAACC
```

FIG. 72E

```
      HisLeuAsnSerThrAlaLeuAsnCysAsnAspSerLeuAsnThrGlyTrpLeuAlaGly
1261  CACCCTCAATAGCACGGCCCTGAACTGCAATGATAGCCTCAACACCGGCTGGTTGGCAGGG
      GTGGGAGTTATCGTGCCGGGACTTGACGTTACTATCGGAGTTGTGGCCGACCAACCGTCCC

LeuPheTyrHisHisLysPheAsnSerSerGlyCysCysProGluArgLeuAlaSerCysArg
1321  CTTTTCTATCACCACAAGTTCAACTCTTCAGGCTGTCCTGAGAGGCTAGCGCCAGCTGCCGA
      GAAAAGATAGTGGTGTTCAAGTTGAGAAGTCCGACAGGACTCTCCGATCGGTCGACGGCT

ProLeuThrAspPheAspGlnGlyTrpGlyProIleSerTyrAlaAsnGlySerGlyPro
1381  CCCCTTACCGATTTGACCAGGGCTGGGGCCCTATCAGTTATGCCAACGGAAGCGGCCCC
      GGGGAATGGCTAAAACTGGTCCCGACCCCGGATAGTCAATACGGTTGCCTTCGCCGGGG

AspGlnArgProTyrCysTrpHisTyrProProLysProCysGlyIleValProAlaLys
1441  GACCAGCGCCCCTACTGCTGGCACTACCCCAAAACCTTGCGGTATTGTCCCGCGAAG
      CTGGTCGCGGGGATGACGACCGTGATGGGGTTTGGAACGCCATAACAGGGCGCTTC

SerValCysGlyProValTyrCysPheThrProSerProValValValGlyThrThrAsp
1501  AGTGTGTGTGTCCGGTATATTGCTTCACTCCCAGCCCGTGGTGGTGGGAACGACCGAC
      TCACACACACACAGGCCATATAACGAAGTGAGGGTCGGGCACCACCCCTTGCTGGCTG

ArgSerGlyAlaProThrTyrTyrSerTrpGlyGluAsnAspThrAspValPheValLeuAsn
1561  AGGTCGGGCGCGCCCACCTACTACAGCTGGGGTGAAAATGATACGGACGTCTTCGTCCTTAAC
      TCCAGCCCGCGCGGGTGGATGTCGACCCCACTTTTACTATGCCTGCAGAAGCAGGAATTG
```

FIG. 72F

```
     AsnThrArgProProLeuGlyAsnTrpPheGlyCysThrPheTrpMetAsnSerThrGlyPhe
1621 AATACCAGGCCACCCGCTGGGCAATTGGTTCGGTTGTACCTTCTGGATGAACTCAACTGGATTC
     TTATGGTCCGGTGCGACCCGTTAACCAAGCCAACATGGACCTACTTGAGTTGACCTAAG

ThrLysValCysGlyAlaProProCysValIleGlyGlyAlaGlyAsnAsnThrLeuHis
1681 ACCAAAGTGTGCGGAGCGCCTCCTTGTGTCATCGGAGGGGCAACAACACCCTGCAC
     TGGTTTCACACGCCTCGCGGAGGAACACAGTAGCCTCCCCGTTGTTGTGGGACGTG

CysProThrAspCysPheArgLysHisProAspAlaThrTyrSerArgCysGlySerGly
1741 TGCCCCACTGATTGCTTCCGCAAGCATCCGGACGCCCACATACTCTCGGTGCGGCTCCGGT
     ACGGGGTGACTAACGAAGGCGTTCGTAGGCCTGCGGGTGTATGAGAGCCACGCCGAGGCCA

ProTrpLeuThrProArgCysLeuValAspTyrProTyrArgLeuTrpHisTyrProCys
1801 CCCTGGATCACACACCCAGGTGCCTGGTCGACTACCCGTATAGGCTTTGGCATTATCCTTGT
     GGGACCTAGTGTGTGGGTCCACGGACCAGCTGATGGGCATATCCGAAACCGTAATAGGAACA

ThrIleAsnTyrThrIlePheLysIleArgMetTyrValGlyGlyValGluHisArgLeu
1861 ACCATCAACTACACCATATTTAAAATCAGGATGTACGTGGGAGGGGTCGAACACAGGCTG
     TGGTAGTTGATGTGGTATAAATTTTAGTCCTACATGCACCCTCCCAGCTTGTGTCCGAC

GluAlaAlaCysAsnTrpThrArgGlyGluArgCysAspLeuGluAspArgAspArgSer
1921 GAAGCTGCCTGCAACTGGACGCGGGCGAACGTTGCGATCTGGAAGACAGGACAGTCC
     CTTCGACGACGTTGACCTGCGCCCCGCTTGCAACGCTAGACCTTCTGTCCCTGTCCAGG

GluLeuSerProLeuLeuLeuThrThrThrGlnTrpGlnValLeuProCysSerPheThr
1981 GAGCTCAGCCCGTTACTGCTGACCACTACACAGTGGCAGGTCCTCCCCGTTCCTTCACA
     CTCGAGTCGGGCAATGACGACTGGTGATGTGTCACCGTCCAGGAGGCACAAGGAAGTGT
```

FIG. 72G

```
      ThrLeuProAlaLeuSerThrGlyLeuIleHisLeuHisGlnAsnIleValAspValGln
2041  ACCCTACCAGCCTTGTCCACCGGCCTCATCCACCTCCACCAGAACATTGTGGACGTGCAG
      TGGGATGGTCGGAACAGGTGGCCGGAGTAGGTGGAGGTGTCTTGTAACACCTGCACGTC

TyrLeuTyrGlyValGlySerSerIleAlaSerTrpAlaIleLysTrpGluTyrValVal
2101  TACTTGTACGGGGTGGGGTCAAGCATCCGGTCCTGGGCCATTAAGTGGGAGTACGTCGTT
      ATGAACATGCCCCACCCCAGTTCGTAGGCGCAGGACCCGGTAATTCACCCTCATGCAGCAA

LeuLeuPheLeuLeuLeuAlaAspAlaArgValCysSerLeuTrpMetMetLeuLeu
2161  CTCCTGTTCCTTCTGCTTGCAGACGCGCGCGTCTGCTCCTTGTGGATGATGCTACTC
      GAGGACAAGGAAGACGAACGTCTGCGCGCGCAGACGAAGGACGAACCTACTACGATGAG

IleSerGlnAlaGluAlaLeuGluAsnLeuValIleLeuAsnAlaAlaSerLeuAla
2221  ATATCCCAAGCGGAGGCGGCTTTGGAGAACCTCGTAATACTTAATGCAGCATCCCTGGCC
      TATAGGGTTCGCCTCCGCCGAAACCTCTTGGAGCATTATGAATTACGTCGTAGGGACCGG

GlyThrHisGlyLeuValSerPheLeuValPheCysPheAlaTrpTyrLeuLysGly
2281  GGGACGCACGGTCTTGTATCCTTCTTTGCTTTCATGGTATTTGAAGGGT
      CCCTGCGTGCCAGAACATAGGAGCACAAGAACGAAACGTACCATATAAACTTCCCA

LysTrpValProGlyMetTrpProLeuLeuLeuLeu
2341  AAGTGGGTGCCCGGAGCGCTACACCTTCTACGGGATGTGGCCTCTCCTGCTCCTG
      TTCACCCACGGGCCTCGCCAGATGTGGAAGATGCCCTACACCGGAGAGGACGAGGAC
```

FIG. 72H

```
      LeuAlaLeuProGlnArgAlaTyrAlaLeuAspThrGluValAlaAlaSerCysGlyGly
2401  TTGGCGTTGCCCCAGCGGGCGTACGCGCTGGACACGGAGGTGGCCGCGTCGTGTGGCGGT
      AACCGCAACGGGGTCGCCCGCATGCGCGACCTGTGCCTCCACCGGCGCAGCACACCGCCA

ValValLeuValGlyLeuMetAlaLeuThrLeuSerProTyrTyrLysArgTyrIleSer
2461  GTTGTTCTCGTGGGTTGATGGCGCTGACTCTGTCACCATATTACAAGCGCTATATCAGC
      CAACAAGAGCAGCCCAACTACCGCGACTGAGACAGTGGTATAATGTTCGCGATATAGTCG

TrpCysLeuTyrTrpLeuGlnTyrPheLeuThrArgValGluAlaGlnLeuHisValTrp
2521  TGGTGCTTGTGTGGCTTCAGTATTTCTGACCAGAGTGGAAGCGCAACTGCACGTGTGG
      ACCACGAACACCACCGAAGTCATAAAGACTGGTCTCACCTTCGCGTTGACGTGCACACC

IleProProLeuAsnValArgGlyGlyArgAspAlaValIleLeuLeuMetCysAlaVal
2581  ATTCCCCCTCAACGTGTCCGAGGGGGGCCGCGACGCGGTCATCTACTACTGTGCTGTA
      TAAGGGGGAGTTGCAGGCTCCCCCCGGCGCTGCGCCAGTAGATGAGTACACACGACAT

HisProThrLeuValPheAspIleThrLysLeuLeuAlaValPheGlyProLeuTrp
2641  CACCCGACTCTGGTATTTGACATCACCAAATTGCTGCCGTCTTCGGACCCCCTTTGG
      GTGGGCTGAGACCATAAACTGTAGTGGTTTAACGACGGCAGAAGCCTGGGGAAACC

IleLeuGlnAlaSerLeuLeuLysValProTyrPheValArgValGlnGlyLeuLeuArg
2701  ATTCTTCAAGCCAGTTTGCTTTAAAGTTCCTTACTTTGTGCGTCAAGGCCTTCTCCGG
      TAAGAAGTTCGGTCAAACGAATTTCATGGGATGAAACACGCGCAGTTCCGAAGAGGCC
```

FIG. 72I

```
      PheCysAlaLeuAlaArgLysMetIleGlyGlyHisTyrValGlnMetValIleIleLys
2761  TTCTGCGCGGTTAGCGCGGAAGATCGGAGGCCATTACGTGCAAATGGTCATCATTAAG
      AAGACGCGCCAATCGCGCCTTCTACTAGCCTCCGGTAATGCACGTTTACCAGTAATTC

LeuGlyAlaLeuThrGlyThrTyrValTyrAsnHisLeuThrProLeuArgAspTrpAla
2821  TTAGGGGCGCTTACTGGCCACCTATGTTTATAACCATCTCACTCCTCTCGGGACTGGGCG
      AATCCCCGCGAATGACCGGTGGATACAAATATTGGTAGAGTGAGGAGAAGCCCTGACCCGC

HisAsnGlyLeuArgAspLeuAlaValAlaValGluProValValPheSerGlnMetGlu
2881  CACAACGGCTTGCGAGATCTGGCCGTGGCCGTGTAGAGCCAGTCGTCTTCTCCCAAATGGAG
      GTGTTGCCGAACGCTCTAGACCGGCACCGGCACATCTCGGTCAGCAGAAGAGGGTTTACCTC

ThrLysLeuIleThrTrpGlyAlaAspThrAlaAlaCysGlyAspIleIleAsnGlyLeu
2941  ACCAAGCTCATCACGTGGGGGCAGATACCGCCGCGGTGCCGGTGACATCATCAACGGCTTG
      TGGTTCGAGTAGTGCACCCCCGTCTATGGCGGCGCCACTGTAGTAGTTGCCGAAC

ProValSerAlaArgArgGlyArgGluIleLeuLeuGlyProAlaAspGlyMetValSer
3001  CCTGTTTCCGCCCGCAGGGCGGGAGATACTGCTCGGGCCAGCCGATGGAATGGTCTCC
      GGACAAAGGCGGGCGTCCCCGCCCCTCTATGACGAGCCCGGTCGGCTACCTTACCAGAGG

LysGlyTyrTrpArgLeuLeuAlaProIleThrArgAlaTyrAlaGlnThrArgGlyLeuLeu
3061  AAGGGGTGGAGTTGCTGGCCGCCATCACGCGCTACGCCCAGACAAGGGGCCTCCTA
      TTCCCCACCTCCAACGACCGGCGGTAGTGCGCATGCGGTCGTCTGTTCCCCGGAGAT

GlyCysIleThrSerLeuThrGlyArgAspLysAsnGlnValGluGlyValGluValGln
3121  GGGTGCATAATCACCAGCCTAACTGGCCGGGACAAAAACCAAGTGGAGGGTGAGGTCCAG
      CCCACGTATTAGTGGTCGGATTGACCGGCCCTGTTTTTGGTTCACTCCTCCCACTCCAGGTC
```

FIG. 72J

```
       IleValSerThrAlaAlaGlnThrPheLeuAlaThrCysIleAsnGlyValCysTrpThr
3181   ATTGTGTCAACTGCTGCTGCCCAAACCTTCCTGGCAACGTGCATCAATGGGGTGTGCTGGACT
       TAACACAGTTGACGACGGGTTTGGAAGGACCGTTGCACGTAGTTACCCCACACGACCTGA

ValTyrHisGlyAlaGlyThrArgThrIleAlaSerProLysGlyProValIleGlnMet
3241   GTCTACCACGGGGCCGGAACGAGGACCATCGCGTCACCCAAGGTCCTGTCATCCAGATG
       CAGATGGTGCCCCGGCCTTGCTCCTGGTAGCGCAGTGGGTTCCCAGGACAGTAGGTCTAC

TyrThrAsnValAspGlnAspLeuValGlyTrpProAlaProGlnGlySerArgSerLeu
3301   TATACCAATGTAGACCAAGACCTTGTGGGCTGGCCCGCTCCGCAAGGTAGCCGCTCATTG
       ATATGGTTACATCTGGTTCTGGAACACCCGACCGGGGCGAGGCGTTCCATCGGCGAGTAAC

ThrProCysThrCysGlySerSerAspLeuTyrLeuValThrArgHisAlaAspValIle
3361   ACACCCTGCACTTGCGGCTCCTCGGACCTTTACCTGGTCACGAGGCACGCCGATGTCATT
       TGTGGGACGTGAACGCCGAGGAGCCTGGAAATGACCAGTGCTCCGTGCGGCTACAGTAA

ProValArgArgArgGlyAspSerArgGlySerLeuLeuSerProArgProIleSerTyr
3421   CCCGTGCGCCGGCGGGGTGATAGCAGGGGCAGCCTGCTGTCGCCCCGGCCCATTCCTAC
       GGGCACGCGGCCGCCCCACTATCGTCCCCGTCGGACGACAGCGGGGCCGGGTAAAGGATG

LeuLysGlySerSerGlyGlyProLeuLeuCysProAlaGlyHisAlaValGlyIlePhe
3481   TTGAAAGGCTCCTCTGGGGGTCCGCTGTTGTGCCCGGGGCACGCCGTGGGCATATTT
       AACTTTCCGAGGAGAGACCCCAGGCGACAACACGGGCCCCCGTGCGGCACCGTATAAA

ArgAlaAlaValCysThrArgGlyValAlaAlaLysAlaValAspPheIleProValGluAsn
3541   AGGGCCGCGGTGTGCACCCGTGGAGTGGCTAAGGCGGTGGACTTTATCCCTGTGGAGAAC
       TCCCGGCGCCACACGTGGGCACCTCACCGATTCCGGCCACCTGAAATAGGGACACCTCTTG
```

FIG. 72K

```
     LeuGluThrThrMetArgSerProValPheThrAspAsnSerSerProValPro
3601 CTAGAGACAACCATGAGGTCCCCGGTTCACGGATAACTCCTCCACCAGTAGTGCCC
     GATCTCTGTTGGTACTCCAGGGGCCACAAGTGCCTATTGAGGAGAGTGGTCATCACGGG

GlnSerPheGlnValAlaHisLeuHisAlaProThrGlySerGlyLysSerThrLysVal
3661 CAGAGCTTCCAGGTGGCTCACCTCCATGCTCCCACCAGCAGCGGCAAAGCACCAAGGTC
     GTCTCGAAGGTCCACCGAGTGGAGGTACGAGGGGTGTCCGTCGCCGTTTCGTGGTTCCAG

ProAlaAlaTyrAlaAlaGlnGlyTyrLysValLeuValLeuAsnProSerValAlaAla
3721 CCGGCTGCATATGCAGCTCAGGGCTATAAGGTGCTAGTACTCAACCCCTCTGTTGCTGCA
     GGCCGACGTATACGTCGAGTCCCGATATTCCACGATCATGAGTTGGGGAGACAACGACGT

ThrLeuGlyPheGlyAlaTyrMetSerLysAlaHisGlyIleAspProAsnIleArgThr
3781 ACACTGGGCTTTGGTGCTTACATGTCCAAGGCTCATGGGATCGATCCTAACATCAGGACC
     TGTGACCCGAAACCACGAATGTACAGGTTCCGAGTACCCTAGCTAGGATTGTAGTCCTGG

GlyValArgThrIleThrThrGlySerProIleThrTyrSerThrTyrGlyLysPheLeu
3841 GGGGTGAGAACAATTACCACTGGCAGCCCCATCACGTACTCCACCTACGGCAAGTTCCTT
     CCCCACTCTTGTTAATGGTGACCGTCGGGGTAGTGCATGAGGTGGATGCCGTTCAAGGAA

AlaAspGlyGlyCysSerGlyGlyAlaTyrAspIleIleIleCysAspGluCysHisSer
3901 GCCGACGGCGGGTGCTCGGGGGGCGCTTATGACATAATTGTGACGAGTGCCACTCC
     CGGCTGCCGCCCACGAGCCCCCGCGAATACTGTATTATTAAACACTGCTCACGGTGAGG
```

FIG. 72L

```
      ThrAspAlaThrSerIleLeuGlyIleGlyThrValLeuAspGlnAlaGluThrAlaGly
3961  ACGGATGCCACATCCATCTTGGGCATCGGCACTGTCTTGACCAAGCAGAGACTGCGGGG
      TGCCTACGGTGTAGGTAGAACCCGTAGCCGTGACAGAACTGGTTCGTCTCTGACGCCCC

AlaArgLeuValValLeuAlaThrAlaProProGlySerValThrValProHisPro
4021  GCGAGACTGGTTGTGCTCGCCACCGCCCCCCGGGCTCCGTCACTGTGCCCCATCCC
      CGCTCTGACCAACAGAGCGGTGGCGGGGGGAGGCCCGAGGCAGTGACACGGGGTAGGG

AsnIleGluGluValAlaLeuSerThrThrGlyGluIleProPheTyrGlyLysAlaIle
4081  AACATCGAGGAGGTTGCTCTGTCCACCACCGGAGAGATCCCTTTTACGGCAAGGCTATC
      TTGTAGCTCCTCCAACGAGACAGGTGGTGGCCTCTCTAGGAAAAATGCCGTTCCGATAG

ProLeuGluValIleLysGlyGlyArgHisLeuIlePheCysHisSerLysLysLysCys
4141  CCCCTCGAAGTAATCAAGGGGGGAGACATCTCATCTTCTGTCATTCAAAGAAGAAGTGC
      GGGGAGCTTCATTAGTTCCCCCCCTCTGTAGAGTAGAAGACAGTAAGTTTCTTCTTCACG

AspGluLeuAlaAlaLysLeuValAlaAlaLeuGlyIleAsnAlaValAlaAlaTyrTyrArgGly
4201  GACGAACTGGCCGCCAAAGCTGGTCGCATTGGGCATCAATGCCGTGGCCTACTACCGCGGT
      CTGCTTGACCGGCGGTTTCGACCAGCGTAACCCGTAGTTACGGCACCGGATGATGGCCA

LeuAspValSerValIleProThrSerGlyAspValValValAlaThrAspAlaLeu
4261  CTTGACGTGTCCGTCATCCCGACCAGCGGCGATGTTGTCGTGGCAACCGATGCCCTC
      GAACTGCACAGGCAGTAGGGCTGGTCGCCGCTACAACAGCAGCCGTTGGCTACGGGAG
```

FIG. 72M

```
      MetThrGlyTyrThrGlyAspPheAspSerValIleAspCysAsnThrCysValThrGln
4321  ATGACCGGCTATACCGGCGACTTCGACTCGGTGATAGACTGCAATACGTGTGTCACCCAG
      TACTGGCCGATATGGCCGCTGAAGCTGAGCCACTATCTGACGTTATGCACACAGTGGGTC

ThrValAspPheSerLeuAspProThrPheThrIleGluThrIleThrLeuProGlnAsp
4381  ACAGTCGATTTCAGCCTTGACCCTACCTTCACCATTGAGACAATCACCCTCCCCCAGGAT
      TGTCAGCTAAAGTCGGAACTGGGATGGAAGTGGTAACTCTGTTAGTGCGAGGGGTCCTA

AlaValSerArgThrGlnArgArgGlyArgThrGlyLysArgGlyLysProGlyIleTyrArg
4441  GCTGTCTCCCGCACTCAACGTCGGGGACTGGGACTGGCAGGGGAAGCCAGGCATCTACAGA
      CGACAGAGGGCGTGAGTTGCAGCCCTGACCCTGACCGTCCCCTTCGGTCCGTAGATGTCT

PheValAlaProGlyGluArgProSerGlyMetPheAspSerValLeuCysSerValCysCys
4501  TTTGTGGCACCGGGGGAGCGCCCCTCCGGCATGTTCGACTCTGTCCTCTGTGAGTGC
      AAACACCGTGGCCCCCTCGCGGGAGGCCGTACAAGCTGAGCAGGAGACACTCACG

TyrAspAlaGlyCysAlaTrpTyrGluThrProAlaGluThrThrValArgLeuArg
4561  TATGACGCAGGCTGTGCTTGGTATGAGACTCCCGAGACTACAGTTAGGCTACGA
      ATACTGCGTCCGACACGAACCATACTCGAGTGCGGGCTCTGATGTCAATCGATGCT

AlaTyrMetAsnThrProGlyLeuProValCysGlnAspHisLeuGluPheTrpGluGly
4621  GCGTACATGAACACCCCGGGCTTCCCGTGCCAGGACCATCTTGAATTTTGGAGGGC
      CGCATGTACTTGTGGGGCCCCGAAGGGCACACGGTCCTGGTAGAACTTAAAACCCTCCCG

ValPheThrGlyLeuThrHisIleAspAlaHisPheLeuSerGlnThrLysGlnSerGly
4681  GTCTTTACAGGCCTCACTCATATAGATGCCCACTTCTATCCCAGACAAAGCAGAGTGGG
      CAGAAATGTCCGGAGTGAGTATATCTACGGGTGAAAGATAGGGTCTGTTTCGTCTCACCC
```

FIG. 72N

```
       GluAsnLeuProTyrLeuValAlaTyrGlnAlaThrValCysAlaArgAlaGlnAlaPro
4741   GAGAACCTTCCTTACCTGGTAGCGTACCAAGCCACCGTGTGCGCTAGGGCTCAAGCCCCT
       CTCTTGGAAGGAATGGACCATCGCATGGTTCGGTGCACACGCGATCCCGAGTTCGGGGA

ProProSerTrpAspGlnMetTrpLysCysLeuIleArgLeuLysProThrLeuHisGly
4801   CCCCCATCGTGGGACCAGATGTGGAAGTGTTTGATTCGCCTCAAGCCCACCCTCCATGGG
       GGGGTAGCACCCTGGTCTACACCTTCACAAACTAAGCGGAGTTCGGGTGGGAGGTACCC

ProThrProLeuLeuTyrArgLeuGlyAlaValGlnAsnGluIleThrLeuThrHisPro
4861   CCAACACCCCTGCTATACAGACTGGGCGCTGTTCAGAATGAAATCACCCTGACGCACCCA
       GGTTGTGGGGACGATATGTCTGACCCGCGACAAGTCTTACTTTAGTGGGACTGCGTGGGT

ValThrLysTyrIleMetThrCysMetSerAlaAspLeuGluValValThrSerThrTrp
4921   GTCACCAAATACATCATGACATGCATGTCGGCCGACCTGGAGGTCGTCACGAGCACCTGG
       CAGTGGTTTATGTAGTACTGTACGTACAGCCGGCTGGACCTCCAGCAGTGCTCGTGGACC

ValLeuValGlyGlyValLeuAlaAlaLeuAlaAlaTyrCysLeuSerThrGlyCysVal
4981   GTGCTCGTTGGCGGCGTCCTGGCTGCCCTTGGCCGCGTATTGCCTGTCAACAGGCTGCGTG
       CACGAGCAACCGCCGCAGGACCGACGGGAAACCGGCTGCATAACGGACAGTTGTCCGACGAC

ValIleValGlyArgValValLeuSerGlyLeuLysProAlaIleIleProAspArgGluVal
5041   GTCATAGTGGGCAGGGTCGTCCTGTCCGGGAAGCCGGCAATCATACCTGACAGGGAAGTC
       CAGTATCACCCGTCCCAGCAGAACAGGCCCTTCGGCCGTTAGTATGGACTGTCCCTTCAG

LeuTyrArgGluPheAspGluMetGluGluCysSerGlnHisLeuProTyrIleGluGln
5101   CTCTACCGAGAGTTCGATGAGATGGAAGAGTGCTCTCAGCACTTACCGTACATCGAGCAA
       GAGATGGCTCTCAAGCTACTCTACCTTCTCACGAGAGTCGTGAATGGCATGTAGCTCGTT
```

FIG. 72O

```
        GlyMetMetLeuAlaGluGlnPheLysGlnLysAlaLeuGlyLeuLeuGlnThrAlaSer
5161    GGGATGATGCTCGCCGAGCAGTTCAAGCAGAAGGCCCTCGGCCTCCTGCAGACCGCGTCC
        CCCTACTACGAGCGGCTCGTCAAGTTCGTCTTCCGGGAGCCGGAGGACGTCTGGCGCAGG

ArgGlnAlaGluValIleAlaProAlaValGlnThrAsnTrpGlnLysLeuGluThrPhe
5221    CGTCAGGCAGAGGTTATCGCCCCTGCTGTCCAGACCAACTGGCAAAAACTCGAGACCTTC
        GCAGTCCGTCTCCAATAGCGGGGACGACAGGTCTGGTTGACCGTTTTTGAGCTCTGGAAG

TrpAlaLysHisMetTrpAsnPheIleSerGlyIleGlnTyrLeuAlaGlyLeuSerThr
5281    TGGGCGAAGCATATGTGGAACTTCATCAGTGGGATACAATACTTGGCGGGCTTGTCAACG
        ACCCGCTTCGTATACACCTTGAAGTAGTCACCCTATGTTATGAACCGCCCGAACAGTTGC

LeuProGlyAsnProAlaIleAlaSerLeuMetAlaPheThrAlaAlaValThrSerPro
5341    CTGCCTGGTAACCCCGCCATTGCTTCATTGATGGCTTTTACAGCTGCTGTCACCAGCCCA
        GACGGACCATTGGGGCGGTAACGAAGTAACTACCGAAAATGTCGACAGTGGTCGGGT

LeuThrThrSerGlnThrLeuLeuPheAsnIleLeuGlyGlyTrpValAlaAlaGlnLeu
5401    CTAACCACTAGCCAAACCCTCCTCTTCAACATATTGGGGGGTGGGCTGGCTGCCCAGCTC
        GATTGGTGATCGGTTTGGGAGGAGAAGTTGTATAACCCCCACCGACGGGTCGAG

AlaAlaProGlyAlaAlaThrAlaPheValGlyAlaGlyLeuAlaAlaGlyAlaAlaIleGly
5461    GCCGCCCCCGGTGCCGCTACTGCCTTTGTGGGCGCTGGCTTAGCTGCGGCCGCCATCGGC
        CGGCGGGGGCCACGGCGATGACGGAAACACCCGCGACCGAATCGACGCCGGCGGTAGCCG
```

FIG. 72P

```
      SerValGlyLeuGlyLysValLeuIleAspIleLeuAlaGlyTyrGlyAlaGlyValAla
      AGTGTTGGGACTGGGGAAGGTCCTCATAGACATCCTTGCAGGGTATGGCGGGGGTGGCG
5521  TCACAACCCTGACCCCCTTCCAGGAGTATCTGTAGGAACGTCCCATACCGCCCCGCACCGC

GlyAlaLeuValAlaPheLysIleMetSerGlyGlyGluValProSerThrGluAspLeuVal
      GGAGCTCTTGTGGCATTCAAGATCATGAGCGGTGAGGTCCCTCCAGGAGGACCTGGTC
5581  CCTCGAGAACACCGTAAGTTCTAGTACTCGCCACTCCAGGGAGGTCCTCCTGGACCAG

AsnLeuLeuProAlaIleLeuLeuSerProGlyAlaLeuValValGlyValValCysAlaAla
      AATCTACTGCCCGCCATCCTCTCCGCCCGAGCCCTCGTAGTCGGCGTGGTTCTGTGCAGCA
5641  TTAGATGACGGGCGGTAGGAGAGCGGGCTCGGGAGCATCAGCCGCACCAGACACGTCGT

IleLeuArgHisValGlyProGlyGluGlyAlaValGlnTrpMetAsnArgLeuIle
      ATACTGCGCCGGCACGTTGGCCCCGGAGGGGCAGTGCAGTGGATGAACCGGCTGATA
5701  TATGACGCGGCCGTGCAACCGGGGCCTCCCCGTCACGTCACCTACTTGGCCGACTAT

AlaPheAlaSerArgGlyAsnHisValSerProThrHisTyrValProGluSerAspAla
      GCCTTCGCCTCCCGGGGAACCATGTTCCCCACGCACTACGTGCCGGAGAGCGATGCA
5761  CGGAAGCGGAGGGCCCCCTTGGTACAAGGGGTGCGTGATGCACGGCCTCTCGCTACGT

AlaAlaArgValThrAlaIleLeuSerSerLeuThrValThrGlnLeuLeuArgArgLeu
      GCTGCCCGCGTCACTGCCATCCTCAGCAGCCTCACTGTAACCCAGCTCCTGAGGCGACTG
5821  CGACGGGCGCAGTGACGGTAGGAGTCGTCGGAGTGACATTGGGTCGAGGACTCCGCTGAC
```

FIG. 72Q

```
5881  HisGlnTrpIleSerSerGluCysThrThrProCysSerGlyThrLysArgAspIle
      CACCAGTGGATAAGCTCGGAGTGTACCACTCCATGCTCCGGTTCCTGGCTAAGGACATC
      GTGGTCACCTATTCGAGCCTCACATGGTGAGGTACGAGGCCAAGGACCGATTCCCTGTAG

5941  TrpAspTrpIleCysGluValLeuSerAspPheLysThrTrpLeuLysAlaLysLeuMet
      TGGGACTGGATATGCGAGGTGTTGAGCGACTTTAAGACCTGGCTAAAAGCTAAGCTCATG
      ACCCTGACCTATACGCTCCACAACTCGCTGAAATTCTGGACCGATTTCGATTCGAGTAC

6001  ProGlnLeuProGlyIleProPheValSerCysGlnArgGlyTyrLysGlyValTrpArg
      CCACAGCTGCCTGGGATCCCCTTTGTGTCCTGCCAGCGCGGGTATAAGGGGTCTGGCGA
      GGTGTCGACGGACCCCTAGGGGAAACACAGGACGGTCGCGCCCATATTCCCCAGACCGCT

6061  ValAspGlyIleMetHisThrArgCysHisCysGlyAlaGluIleThrGlyHisValLys
      GTGGACGGCATCATGCACACTCGCTGCCACTGTGGAGCTGAGATCACTGGACATGTCAAA
      CACCTGCCGTAGTACGTGTGAGCGACGGTGACACCTCGACTCTAGTGACCTGTACAGTTT

6121  AsnGlyThrMetArgIleValGlyProArgThrCysArgAsnMetTrpSerGlyThrPhe
      AACGGGACGATGAGGATCGTCGGTCCTAGAGACCTGCAGGAACATGTGGAGTGGGACCTTC
      TTGCCCCTGCTACTCCTAGCAGCAGGATCCTGGACGTCCTTGTACACCTCACCCTGGAAG

6181  ProIleAsnAlaTyrThrThrGlyProCysThrGlyProLeuProAlaProAsnTyrThrPhe
      CCCATTAATGCCTACACCACGGGCCCCTGTACCCCCTTCCTGCCGCCAACTACACGTTC
      GGGTAATTACGGATGTGGTGCCCGGGGACATGGGGAAGGACGGCGGCTTGATGTGCAAG
```

FIG. 72R

```
       AlaLeuTrpArgValSerAlaGluTyrValGluIleArgGlnValGlyAspPheHis
6241   GCGCTATGGAGGGTGTCTGCAGAGAGGAATATGTGGAGATAAGGCAGGTGGGGACTTCCAC
       CGCGATACCTCCCACAGACGTCTCTTATACACCTCTATTCCGTCCACCCCTGAAGGTG

TyrValThrGlyMetThrThrAspAsnLeuLysCysProCysGlnValProSerProGlu
6301   TACGTGACGGGTATGACTACTGACAATCTCAAATGCCCGTGCCAGGTCCCATGCCCGAA
       ATGCACTGCCCATACTGATGACTGTTAGAGTTTACGGGCACGGTCCAGGTAGCCGGCTT

PhePheThrGluLeuAspGlyValArgLeuHisArgPheAlaProProCysLysProLeu
6361   TTTTTCACAGAATTGGACGGGTGCGCCTACATAGGTTTGCGCCCCTGCAAGCCCTTG
       AAAAAGTGTCTTAACCTGCCCACGCGGATGTATCCAAACGCGGGGACGTTCGGAAC

LeuArgGluValSerPheArgValGlyLeuHisGluTyrProValGlySerHisLeu
6421   CTGCGGGAGGAGTATCATTCAGAGTAGGACTCCACGAATACCCGGTAGGTCGCAATTA
       GACGCCCCTCCTCCATAGTAAGTCTCATCCTGAGGTGCTTATGGGCCATCCCAGCGTTAAT

ProCysGluProAspValAlaValLeuThrSerMetLeuThrAspProSerHis
6481   CCTTGCGAGCCCGAACCCGGACGACGTTGGCCCGTGTTGACGTCCATGCTCACTGATCCCCAT
       GGAACGCTCGGGCTTGGCCCTGCACCGGCACAACTGCAGGTACGAGTGACTAGGAGGGTA

IleThrAlaGluAlaAlaGlyArgArgLeuAlaArgGlySerProProSerValAlaSer
6541   ATAACAGCAGAGGCGGCGGGCGGAAGGTTGGCGAGGGGATCACCCCTCTGTGCCAGC
       TATTGTCGTCTCCGCCGCCCGCCTTCCAACCGCTCCCCTAGTGGGGGAGACACCGGTCG
```

FIG. 72S

```
       SerSerAlaSerGlnLeuSerAlaProSerLeuLysAlaThrCysThrAlaAsnHisAsp
6601   TCCTCGGCTAGCCAGCTATCCGCTCCATCTCTCAAGGCAACTTGCACCGCTAACCATGAC
       AGGAGCCGATCGGTCGATAGGCGAGGTAGAGAGTTCCGTTGAACGTGGCGATTGGTACTG

SerProAspAlaGluLeuIleGluAlaAsnLeuLeuTrpArgGlnGluMetGlyGlyAsn
6661   TCCCCTGATGCTGAGCTCATAGAGGCCAACCTCCTATGGAGGCAGGAGATGGGCGGCAAC
       AGGGGACTACGACTCGAGTATCTCCGGTTGGAGGATACCTCCGTCCTCTACCGCCGTTG

IleThrArgValGluSerGluAsnLysValValIleLeuAspSerPheAspProLeuVal
6721   ATCACCAGGGTTGAGTCAGAAAACAAAGTGGTAATTCTGGACTCCTTCGATCCGCTTGTG
       TAGTGGTCCCAACTCAGTCTTTTGTTTCACCATTAAGACCTGAGGAAGCTAGGCGAACAC

AlaGluAspGluArgGluIleLeuArgLysSerArgArg
6781   GCGGAGGACGAGAGGGAGATCCTGCGTACCGCAGAAATCCTGCGGAAGTCTCGGAGA
       CGCCTCCTCCTGCTCCTCTAGGAGCGCATGGGCGTCTTTAGGACGCCTTCAGAGCTCT

PheAlaGlnAlaLeuProValTrpAlaArgProAspTyrAsnProProLeuValGluThr
6841   TTCGCCCAGGCCCTGCCCGTTTGGGCGCGCCCGGACTATAACCCCCCGCTAGTGGAGACG
       AAGCGGGTCCGGGACGGGCAAACCCGCGGCCCTGATATTGGGGGCGATCACCTCGC

TrpLysLysProAspTyrGluProProValHisGlyCysProLeuProProProLys
6901   TGGAAAAAGCCCGACTACGAACCACCTGGTCCATGGCTGTCCGCTTCCACCTCCAAAG
       ACCTTTTTCGGGCTGATGCTTGGTGGACACCAGGTACCGACAGGCGAAGGTGGAGGTTTC

SerProProValProProProArgLysLysArgThrValValLeuThrGluSerThrLeu
6961   TCCCCTCCTGTGCCTCCGCCTCGGAAGAAGCGGACGGTCCTCACTGAATCAACCCTA
       AGGGGAGGACACGGAGGCGGAGCCTTCTTCGCCTGCCAGGAGTGACTTAGTGGGAT
```

FIG. 72T

```
      SerThrAlaLeuAlaGluLeuAlaThrArgSerPheGlySerSerThrSerGlyIle
7021  TCTACTGCCTTGCCGAGCTCGCCACCAGAAGCTTTGGCAGCTCCTCAACTTCCGCATT
      AGATGACGGAACCGGCTCGAGCGGTGGTCTTCGAAACCGTCGAGGAGTTGAAGGCCGTAA

ThrGlyAspAsnThrThrSerSerGluProAlaProSerGlyCysProProAspSer
7081  ACGGGCGACAATACGACAACATCCTCTGAGCCCGCCCCTTCTGGCTGCCCCCCGACTCC
      TGCCCGCTGTTATGCTGTTGTAGGAGACTCGGGCGGGGAAGACCGACGGGGGCTGAGG

AspAlaGluSerTyrSerSerMetProProLeuGluGlyGluProGlyAspProAspLeu
7141  GACGCTGAGTCCTATTCCTCCATGCCCCCCCTGGAGGGGGAGCCTGGGGATCCGGATCTT
      CTGCGACTCAGGATAAGGAGGTACGGGGGGGACCTCCCCCTCGGACCCCTAGGCCTAGAA

SerAspGlySerTrpSerThrValSerSerGluAlaAsnAlaGluAspValValCysCys
7201  AGCGACGGGTCATGGTCAACGGTCAGTAGTGAGGCCAACGCGGAGGATGTCGTGTGCTGC
      TCGCTGCCCAGTACCAGTTGCCAGTCATCACTCCGGTTGCGCCTCCTACAGCACACGACG

SerMetSerTyrSerTrpThrGlyAlaLeuValThrProCysAlaAlaGluGlnLys
7261  TCAATGTCTTACTCTTGGACAGGCGCACTCGTCACCCCGTGCCGCGAAGAACAGAAA
      AGTTACAGAATGAGAACCTGTCCGCGTGAGCAGTGGGGCACGGCGCCTTCTTGTCTTT

LeuProIleAsnAlaLeuSerAsnSerLeuLeuArgHisHisAsnLeuValTyrSerThr
7321  CTGCCCATCAATGCACTAAGCAACTCGTTGCTACGTCACCACAATTGGTGTATTCCACC
      GACGGGTAGTTACGTGATTCGTTGAGCAACGATGCAGTGGTGTTAAACCACATAAGGTGG
```

FIG. 72U

```
      ThrSerArgSerAlaCysGlnArgGlnLysLysValThrPheAspArgLeuGlnValLeu
7381  ACCTCACGCGTCTGCTTGCCAAAGGCAGAAGAAAGTCACATTTGACAGACTGCAAGTTCTG
      TGGAGTGCGTCACGAACGGTTCCGTCTTCTTTCAGTGTAAACTGTCTGACGTTCAAGAC

AspSerHisTyrGlnAspValLeuLysGluValLysAlaAlaAlaSerLysValLysAla
7441  GACAGCCATTACCAGGACGTACTCAAGGAGGTTAAAGCAGGCGTCAAAAGTGAAGGCT
      CTGTCGGTAATGGTCCTGCATGAGTTCCTCCAATTTCGTCCGCAGTTTCACTTCCGA

AsnLeuSerValGluGluAlaCysSerLeuThrProProHisSerAlaLysSerLys
7501  AACTTGCTATCCGTAGAGGAAGCTTGCAGCCTGACGCCCCACACTCAGCCAAATCCAAG
      TTGAACGATAGGCATCTCCTTCGAACGTCGGACTGCGGGGTGTGAGTCGGTTTAGGTTC

PheGlyTyrGlyAlaLysAspValArgCysHisAlaArgLysAlaValThrHisIleAsn
7561  TTTGGTTATGGGGCAAAAGACGTCCGTTGCCATGCCAGAAAGGCCGTAACCCACATCAAC
      AAACCAATACCCCGTTTTCTGCAGGCAACGGTACGGTCTTTCCGGCATTGGGTAGTTG

SerValTrpLysAspLeuLeuGluAspAsnValThrProIleAspThrThrIleMetAla
7621  TCCGTGTGGAAAGACCTTCTGGAAGACAATGTAACACCAATAGACACTACCATCATGCT
      AGGCACACCTTTCTGGAAGACCTTCTGTTACATTGTGGTTATCTGTGATGGTAGTACCGA

LysAsnGluValPheCysValGlnProGluLysGlyArgLysProAlaArgLeuIle
7681  AAGAACGAGGTTTTCTGCGTTCAGCCTGAGAAGGGGTCGTAAGCCAGCTCGTCTCATC
      TTCTTGCTCCAAAAGACGCAAGTCGGACTCTTCCCCCAGCATTCGGTCGAGCAGAGTAG

ValPheProAspLeuGlyValArgValCysGluLysMetAlaLeuTyrAspValValThr
7741  GTGTTCCCCGATCTGGGCGTGCGCGTGTGCGAAAAGATGGCTTTGTACGACGTGGTTACA
      CACAAGGGCTAGACCCGCACGCGCACACGCTTTTCTACCGAAACATGCTGCACCAATGT
```

FIG. 72V

```
      LysLeuLeuAlaValMetGlySerSerTyrGlyPheGlnTyrSerProGlyGlnArg
7801  AAGCTCCCCTTGGCCGTGATGGGAAGCTCCTACGGATTCCAATACTACCAGGACAGCGG
      TTCGAGGGAACCGGCACTACCCTTCGAGGATGCCTAAGGTTATGAGTGGTCCTGTCGCC

ValGluPheLeuValGlnAlaTrpLysSerLysThrProMetGlyPheSerTyrAsp
7861  GTTGAATTCCTCGTGCAAGCGTGGAAGTCCAAGAAAACCCAATGGGTTCTGTATGAT
      CAACTTAAGGAGCACGTTCGCACCTTCAGGTTCTTTTGGGTTACCCAAGAGCATACTA

ThrArgCysPheAspSerThrValThrGluSerAspIleArgThrGluAlaIleTyr
7921  ACCCGCTGCTTTGACTCCACAGTCACTGAGAGCGACATCCGTACGGAGGAGCAATCTAC
      TGGGCGACGAAACTGAGGTGTCAGTGACTCTCGCTGTAGGCATGCCTCCTCCGTTAGATG

GlnCysCysAspLeuAspProGlnAlaArgValAlaIleLysSerLeuThrGluArgLeu
7981  CAATGTTGTGACCTCGACCCCCAAGCCCGCGTGGCCATCAAGTCCCTCACCGAGAGCTT
      GTTACAACACTGGAGCTGGGGGTTCGGGCGCACCGGTAGTTCAGGGAGTGGCTCTCCGAA

TyrValGlyProLeuThrAsnSerArgGlyGluAsnCysGlyTyrArgArgCysArg
8041  TATGTTGGGGCCCCTCTTACCAATTCAAGGGGAGAACTGCGGCTATCGCAGGTGCCGC
      ATACAACCCCGGGGAGAATGGTTAAGTTCCCCCTCTTGACGCCGATAGCGTCCACGGCG

AlaSerGlyValLeuThrThrSerCysGlyAsnThrLeuThrCysTyrIleLysAlaArg
8101  GCGAGCGGCGTACTGACAACTAGCTGTGGTAACACCCTCACTTGCTACATCAAGGCCCGG
      CGCTCGCCGCATGACTGTTGATCGACACCATTGTGGGAGTGAACGATGTAGTTCCGGGCC
```

FIG. 72W

```
        AlaAlaCysArgAlaAlaGlyLeuLeuGlnAspCysThrMetLeuValCysGlyAspAspLeu
8161    GCAGCCTGTCGAGCCGCAGGCCTCCTGCAGGACTGCACCATGCTCGTGTGTGGCGACGACTTA
        CGTCGGACAGCTCGGCGTCCGGAGGACTCCCTGACGTGGTACGAGCACACACCGCTGCTGAAT

ValValIleCysGluSerAlaGlyValGlnGluAspAlaAlaSerLeuArgAlaPheThr
8221    GTCGTTATCTGTGAAAGCGCGGGGGTCCAGGAGGACGCGGCGAGCCTGAGAGCCTTCACG
        CAGCAATAGACACTTTCGCGCCCCCAGGTCCTCCTGCGCCGCTCGGACTCTCGGAAGTGC

GluAlaMetThrArgTyrSerAlaProProGlyAspProProGlnProProGluTyrAspLeu
8281    GAGGCTATGACCAGGTACTCCGCCCCCCTGGGACCCCCACCACCAGAATACGACTTG
        CTCCGATACTGGTCCATGAGGCGGGGGGACCCCTGGGGGTGGTGGTCTTATGCTGAAC

GluLeuIleThrSerCysSerSerAsnValSerValAlaHisAspGlyAlaGlyLysArg
8341    GAGCTCATAACATCATGCTCCTCCAACGTGTCAGTCGCCCACGACGGCGCTGGAAAGAGG
        CTCGAGTATTGTAGTACGAGGAGGTTGCACAGTCAGCGGGTGCTGCCGCGACCTTTCTCC

ValTyrTyrLeuThrArgAspProThrThrProLeuAlaArgAlaAlaTrpGluThrAla
8401    GTCTACTACCTCACCCGTGACCCTACAACCCCTCGCGAGAGCCTGCGTGGGAGACAGCA
        CAGATGATGGAGTGGGCACTGGGATGTTGGGGAGCGCTCTCGACGCACCCTCTGTCGT

ArgHisThrProValAsnSerTrpLeuGlyAsnIleIleMetPheAlaProThrLeuTrp
8461    AGACACACTCCAGTCAATTCCTGGCTAGGCAACATAATCATGTTTGCCCCACACTGTGG
        TCTGTGTGAGGTCAGTTAAGGACCGATCCGTTGTATTAGTACAAACGGGGTGTGACACC
```

FIG. 72X

```
         AlaArgMetIleLeuMetThrHisPhePheSerValLeuIleAlaArgGlnLeuGlu
         GCGAGGATGATACTGATGACCCATTTCTTTAGCGTCCTTATAGCCAGGACCAGCTTGAA
8521     CGCTCCTACTATGACTACTGGGTAAAGAAATCGCAGGAATATCGGTCCCTGGTCGAACTT

GlnAlaLeuAspCysGluIleTyrGlyAlaCysTyrSerIleGluProLeuAspLeuPro
         CAGGCCCTCGATTGCGAGATCTACGGCGCCTGCTACTCCATAGAACCACTTGATCTACCT
8581     GTCCGGGAGCTAACGCTCTAGATGCCGCGGACGATGAGGTATCTTGGTGAACTAGATGGA

ProIleGlnArgLeuHisGlyLeuSerAlaPheSerLeuHisSerTyrSerProGly
         CCAATCATTCAAAGACTCCATGGCCTCAGCGCCTTCACTCTCCACAGTTACTCTCCAGGT
8641     GGTTAGTAAGTTTCTGAGGTACCGGAGTCGCGGAAGTGAGGTGTCAATGAGAGGTCCA

GluIleAsnArgValAlaAlaCysLeuArgLysLeuGlyValProProLeuArgAlaTrp
         GAAATTAATAGGGTGGCCGCATGCCTCAGAAAACTTGGGGTACCGCCCTTGCGAGCTTGG
8701     CTTTAATTATCCCACCGGCGTACGGAGTCTTTTGAACCCCATGGCGGGAACGCTCGAACC

ArgHisArgAlaArgSerValArgAlaArgLeuLeuAlaArgGlyGlyArgAlaAlaIle
         AGACACCGGGCCCGGAGCGTCCGCGCGTCTGGCCAGAGGAGCAGGCGGCTGCCATA
8761     TCTGTGGCCCGGGCCTCGCAGGCGCGCAGACGGTCTCCTCCGAAGACCGTTCCCGACGGTAT

CysGlyLysTyrLeuPheAsnTrpAlaValArgThrLysLeuLysLeuThrProIleAla
         TGTGGCAAGTACCTCTTCAACTGGGCAGTAAGAACAAAGCTCAAACTCACTCCAATAGCG
8821     ACACCGTTCATGGAGAAGTTGACCCGTCATTCTTGTTTCGAGTTTGAGTGAGGTTATCGC
```

FIG. 72Y

```
8881  AlaAlaGlyGlnLeuAspLeuSerGlyTrpPheThrAlaGlyTyrSerGlyGlyAspIle
      GCCGCTGGCCAGCTGGACTTGTCCGGCTGGTTCACGGCTGGCTACAGCGGGGGAGACATT
      CGGCGACCGGTCGACCTGAACAGGCCGACCAAGTGCCGACCGATGTCGCCCCTCTGTAA

8941  TyrHisSerValSerHisAlaArgProArgTrpIleTrpPheCys
      TATCACAGCGTGTCTCATGCCCGGCTGGATCTGGTTTTGCCC
      ATAGTGTCGCACAGAGTACGGGCCGACCTAGACCAAAACGGG
```

```
            GluPheGlySerValIleProThrSerGlyAspValValValValAlaThrAspAlaLeu
   1        GAATTCGGGTCCGTCATCCCGACCAGCGGCGATGTTGTCGTCGTGGCAACCGATGCCCTC
            CTTAAGCCCAGGCAGTAGGGCTGGTCGCCGCTACAACAGCAGCACCGTTGGCTACGGGAG

1 ECOR1, 7 NLA1V, 8 AVA2 SAU96, 15 FOK1, 24 NSPB11, 26 FNU4H
   1, 52 SFAN1, 57 MNL1, 60 NLA111,

MetThrGlyTyrThrGlyAspPheAspSerValIleAspCysAsnThrCysValThrGln
  61        ATGACCGGCTATACCGGCGACTTCGACTCGGTGATAGACTGCAATACGTGTGTCACCCAG
            TACTGGCCGATATGGCCGCTGAAGCTGAGCCACTATCTGACGTTATGCACACAGTGGGTC

65 HPA11, 74 HPA11, 83 TAQ1, 85 HINF1, 90 HPH, 106 AFL111 MA
  E2, 112 MAE3, 113 HPH,

ThrValAspPheSerLeuAspProThrPheThrIleGluThrIleThrLeuProGlnAsp
 121        ACAGTCGATTTCAGCCTTGACCCTACCTTCACCATTGAGACAATCACGCTCCCCCAAGAT
            TGTCAGCTAAAGTCGGAACTGGGATGGAAGTGGTAACTCTGTTAGTGCGAGGGGGTTCTA

125 TAQ1, 149 HPH, 178 SFAN1,

AlaValSerArgThrGlnArgArgGlyArgThrGlyArgGlyLysProGlyIleTyrArg
 181        GCTGTCTCCCGCACTCAACGTCGGGGCAGGACTGGCAGGGGGAAGCCAGGCATCTACAGA
            CGACAGAGGGCGTGAGTTGCAGCCCCGTCCTGACCGTCCCCCTTCGGTCCGTAGATGTCT

198 MAE2, 226 ECOR11 SCRF1, 230 SFAN1,

PheValAlaProGlyGluArgProProAlaCysSerThrArgProSerSerValSerAla
 241        TTTGTGGCACCGGGGGAGCGCCCTCCGGCATGTTCGACTCGTCCGTCCTCTGTGAGTGCC
            AAACACCGTGGCCCCCTCGCGGGAGGCCGTACAAGCTGAGCAGGCAGGAGACACTCACGG

246 BAN1 NLA1V, 250 HPA11 NCI1 SCRF1, 257 HAE11, 258 HHA1, 2
 62 MNL1, 265 HPA11, 268 NSPC1, 269 NLA111, 274 TAQ1, 276 HIN
 F1, 287 MNL1, 296 BSP1286,

ArgIle
 301        CGAATTC
            GCTTAAG

302 ECOR1,

```
         ------Overlap with 6k------
      TyrHisSerValSerHisAlaArgProArgTrpIleTrpPheCysLeuLeuLeuLeuAla
  1   TTATCACAGGTGTCTCATGCCCGGCCCCGCTGGATCTGGTTTGCCTACTCCTGCTTGC
      AATAGTGTCGCACAGAGTACGGGCCGGGGCGACCTAGACCAAAACGGATGAGGACGAACG AlaGlyValGlyIleTyrLeuLeuProAsnArgOP
 61   TGCAGGGGTAGGCATTCTACCTCCTCCCCAACCGATGAAGGTTGGGTAAACACTCCGGCC
      ACGTCCCCATCCGTAGAGATGGAGGAGGGGGTTGGCTACTTCCAACCCATTTGTGAGGCCGG

```
    AlaValAspPheIleProValGluAsnLeuGluThrThrMetArgSerProValPheThr
  2 GCGGTGGACTTTATCCCTGTGGAGAACCTAGAGACAACCATGAGGTCCCCGGTGTTCACG
    CGCCACCTGAAATAGGGACACCTCTTGGATCTCTGTTGGTACTCCAGGGGCCACAAGTGC
```

29 MAE1, 40 NLAlll, 43 MNL1, 45 AVA2 NLA1V SAU96, 49 NCI1 SC
RF1, 50 HPAll,

```
    AspAsnSerSerProProValValProGlnSerPheGlnValAlaHisLeuHisAlaPro
 62 GATAACTCCTCTCCACCAGTAGTGCCCCAGAGCTTCCAGGTGGCTCACCTCCATGCTCCC
    CTATTGAGGAGAGGTGGTCATCACGGGGTCTCGAAGGTCCACCGAGTGGAGGTACGAGGG
```

69 MNL1, 83 BSP1286, 92 ALU1, 97 ECOR11 SCRF1, 106 HPH, 109
MNL1, 113 NLAlll,

```
    ThrGlySerGlyLysSerThrLysValProAlaAlaTyrAlaAlaGlnGlyTyrLysVal
122 ACAGGCAGCGGCAAAAGCACCAAGGTCCCGGCTGCATATGCAGCTCAGGGCTATAAGGTG
    TGTCCGTCGCCGTTTTCGTGGTTCCAGGGCCGACGTATACGTCGAGTCCCGATATTCCAC
```

126 BBV FNU4H1, 127 NSPB11, 129 FNU4H1, 145 AVA2 NLA1V SAU96
, 148 NCI1 SCRF1, 149 HPAll, 152 BBV FNU4H1, 156 NDE1, 161 B
BV FNU4H1, 163 ALU1, 165 DDE1,

```
    LeuValLeuAsnProSerValAlaAlaThrLeuGlyPheGlyAlaTyrMetSerLysAla
182 CTAGTACTCAACCCCTCTGTTGCTGCAACACTGGGCTTTGGTGCTTACATGTCCAAGGCT
    GATCATGAGTTGGGGAGACAACGACGTTGTGACCCGAAACCACGAATGTACAGGTTCCGA
```

182 MAE1, 184 SCA1, 185 RSA1, 195 MNL1, 203 BBV FNU4H1, 228
AFL111 NSPC1, 229 NLAlll,

```
    HisGlyIleAspProAsnIleArgThrGlyValArgThrIleThrThrGlySerProIle
242 CATGGGATCGATCCTAACATCAGGACCGGGGTGAGAACAATTACCACTGGCAGCCCCATC
    GTACCCTAGCTAGGATTGTAGTCCTGGCCCCACTCTTGTTAATGGTGACCGTCGGGGTAG
```

242 NLAlll, 246 BIN1, 247 MBO1 SAU3A, 248 CLA1, 249 TAQ1, 25
1 BIN1 MBO1 SAU3A, 264 AVA2 SAU96, 267 HPAll NCI1 SCRF1, 271
 HPH, 291 BBV FNU4H1,

```
    ThrTyrSerThrTyrGlyLysPheLeuAlaAspGlyGlyCysSerGlyGlyAlaTyrAsp
302 ACGTACTCCACCTACGGCAAGTTCCTTGCCGACGGCGGGTGCTCGGGGGGCGCTTATGAC
    TGCATGAGGTGGATGCCGTTCAAGGAACGGCTGCCGCCCACGAGCCCCCGCGAATACTG
```

302 MAE2, 304 RSA1, 340 BSP1286 HGIA, 343 AVA1, 350 HAE11, 3
51 HHA1,

```
    IleIleIleCysAspGluCysHisSerThrAspAlaThrSerIleLeuGlyIleGlyThr
362 ATAATAATTTGTGACGAGTGCCACTCCACGGATGCCACATCCATCTTGGGCATTGGCACT
    TATTATTAAACACTGCTCACGGTGAGGTGCCTACGGTGTAGGTAGAACCCGTAACCGTGA
```

372 MAE3, 391 FOK1, 392 SFAN1, 399 FOK1,

```
    ValLeuAspGlnAlaGluThrAlaGlyAlaArgLeuValValLeuAlaThrAlaThrPro
422 GTCCTTGACCAAGCAGAGACTGCGGGGGCGAGACTGGTTGTGCTCGCCACCGCCACCCCT
    CAGGAACTGGTTCGTCTCTGACGCCCCCGCTCTGACCAACACGAGCGGTGGCGGTGGGA
```

431 TTHIII2, 435 ALWN1, 461 BSP1286 HGIA, 479 MNL1,

FIG. 79B

```
        ProGlySerValThrValProHisProAsnIleGluGluValAlaLeuSerThrThrGly
482     CCGGGCTCCGTCACTGTGCCCCATCCCAACATCGAGGAGGTTGCTCTGTCCACCACCGGA
        GGCCCGAGGCAGTGACACGGGGTAGGGTTGTAGCTCCTCCAACGAGACAGGTGGTGGCCT
```

482 HPAll NCIl SCRFl, 484 BANll BSP1286, 485 NLAlV, 491 MAE3
, 497 BSP1286, 503 FOKl, 513 TAQl, 515 MNLl, 518 MNLl, 537 H
PAll,

```
        GluIleProPheTyrGlyLysAlaIleProLeuGluValIleLysGlyGlyArgHisLeu
542     GAGATCCCTTTTTACGGCAAGGCTATCCCCCTCGAAGTAATCAAGGGGGGAGACATCTC
        CTCTAGGGAAAAATGCCGTTCCGATAGGGGGAGCTTCATTAGTTCCCCCCCTCTGTAGAG
```

543 XHO2, 544 BINl MBOl SAU3A, 571 MNLl, 573 TAQl,

```
        IlePheCysHisSerLysLysLysCysAspGluLeuAlaAlaLysLeuValAlaLeuGly
602     ATCTTCTGTCATTCAAAGAAGAAGTGCGACGAACTCGCCGCAAAGCTGGTCGCATTGGGC
        TAGAAGACAGTAAGTTTCTTCTTCACGCTGCTTGAGCGGCGTTTCGACCAGCGTAACCCG
```

603 MBOll, 619 MBOll, 638 FNU4Hl, 645 ALUl, 660 SFANl,

```
        IleAsnAlaValAlaTyrTyrArgGlyLeuAspValSerValIleProThrSerGlyAsp
662     ATCAATGCCGTGGCCTACTACCGCGGTCTTGACGTGTCCGTCATCCCGACCAGCGGCGAT
        TAGTTACGGCACCGGATGATGGCGCCAGAACTGCACAGGCAGTAGGGCTGGTCGCCGCTA
```

672 HAEl, 673 HAElll, 682 NSPBll SAC2, 683 THAl, 693 AFLlll
MAE2, 703 FOKl, 712 NSPBll, 714 FNU4Hl,

```
        ValValValValAlaThrAspAlaLeuMetThrGlyTyrThrGlyAspPheAspSerVal
722     GTTGTCGTCGTGGCAACCGATGCCCTCATGACCGGCTATACCGGCGACTTCGACTCGGTG
        CAACAGCAGCACCGTTGGCTACGGGAGTACTGGCCGATATGGCCGCTGAAGCTGAGCCAC
```

740 SFANl, 745 MNLl, 748 NLAlll, 753 HPAll, 762 HPAll, 771 T
AQl, 773 HINFl, 778 HPH,

```
        IleAspCysAsnThrCysValThrGlnThrValAspPheSerLeuAspProThrPheThr
782     ATAGACTGCAATACGTGTGTCACCCAGACAGTCGATTTCAGCCTTGACCCTACCTTCACC
        TATCTGACGTTATGCACACAGTGGGTCTGTCAGCTAAAGTCGGAACTGGGATGGAAGTGG
```

794 AFLlll MAE2, 800 MAE3, 801 HPH, 813 TAQl, 837 HPH,

```
        IleGluThrIleThrLeuProGlnAspAlaValSerArgThrGlnArgArgGlyArgThr
842     ATTGAGACAATCACGCTCCCCCAAGATGCTGTCTCCCGCACTCAACGTCGGGGCAGGACT
        TAACTCTGTTAGTGCGAGGGGGTTCTACGACAGAGGGCGTGAGTTGCAGCCCCGTCCTGA
```

866 SFANl, 886 MAE2,

```
        GlyArgGlyLysProGlyIleTyrArgPheValAlaProGlyGluArgProSerGlyMet
902     GGCAGGGGGAAGCCAGGCATCTACAGATTTGTGGCACCGGGGGAGCGCCCCTCCGGCATG
        CCGTCCCCCTTCGGTCCGTAGATGTCTAAACACCGTGGCCCCCTCGCGGGGAGGCCGTAC
```

914 ECORll SCRFl, 918 SFANl, 934 BANl NLAlV, 938 HPAll NCIl
SCRFl, 945 HAEll, 946 HHAl, 948 BGLl, 951 MNLl, 954 HPAll, 9
57 NSPCl, 958 NLAlll,

```
        PheAspSerSerValLeuCysGluCysTyrAspAlaGlyCysAlaTrpTyrGluLeuThr
962     TTCGACTCGTCCGTCCTCTGTGAGTGCTATGACGCAGGCTGTGCTTGGTATGAGCTCACG
        AAGCTGAGCAGGCAGGAGACACTCACGATACTGCGTCCGACACGAACCATACTCGAGTGC
```

963 TAQl, 965 HINFl, 976 MNLl, 992 HGAl, 1003 TTHIII2, 1013
BANll BSP1286 HGIA SACl, 1014 ALUl,

```
        ProAlaGluThrThrValArgLeuArgAlaTyrMetAsnThrProGlyLeuProValCys
1022    CCCGCCGAGACTACAGTTAGGCTACGAGCGTACATGAACACCCCGGGGCTTCCCGTGTGC
        GGGCGGCTCTGATGTCAATCCGATGCTCGCATGTACTTGTGGGGCCCCGAAGGGCACACG
```

FIG. 79C

1051 RSA1, 1054 NLA111, 1063 AVA1 NCI1 SCRF1 SMA1, 1064 HPA1
1 NCI1 SCRF1, 1081 ECOR11 SCRF1,

```
     GlnAspHisLeuGluPheTrpGluGlyValPheThrGlyLeuThrHisIleAspAlaHis
1082 CAGGACCATCTTGAATTTTGGGAGGGCGTCTTTACAGGCCTCACTCATATAGATGCCCAC
     GTCCTGGTAGAACTTAAAACCCTCCCGCAGAAATGTCCGGAGTGAGTATATCTACGGGTG
```

1084 AVA2 SAU96, 1103 MNL1, 1106 AHA11, 1107 HGA1, 1117 HAE1
STU1, 1118 HAE111, 1120 MNL1, 1133 SFAN1,

```
     PheLeuSerGlnThrLysGlnSerGlyGluAsnLeuProTyrLeuValAlaTyrGlnAla
1142 TTTCTATCCCAGACAAAGCAGAGTGGGGAGAACCTTCCTTACCTGGTAGCGTACCAAGCC
     AAAGATAGGGTCTGTTTCGTCTCACCCCTCTTGGAAGGAATGGACCATCGCATGGTTCGG
```

1183 ECOR11 SCRF1, 1192 RSA1, 1201 DRA3,

```
     ThrValCysAlaArgAlaGlnAlaProProProSerTrpAspGlnMetTrpLysCysLeu
1202 ACCGTGTGCGCTAGGGCTCAAGCCCCTCCCCCATCGTGGGACCAGATGTGGAAGTGTTTG
     TGGCACACGCGATCCCGAGTTCGGGGAGGGGGTAGCACCCTGGTCTACACCTTCACAAAC
```

1209 HHA1, 1212 MAE1, 1215 BAN11 BSP1286, 1226 MNL1, 1239 NL
A1V, 1240 AVA2 SAU96, 1256 TTHIII2, 1261 HINF1,

```
     IleArgLeuLysProThrLeuHisGlyProThrProLeuLeuTyrArgLeuGlyAlaVal
1262 ATTCGCCTCAAGCCCACCCTCCATGGGCCAACACCCCTGCTATACAGACTGGGCGCTGTT
     TAAGCGGAGTTCGGGTGGGAGGTACCCGGTTGTGGGGACGATATGTCTGACCCGCGACAA
```

1267 MNL1, 1279 MNL1, 1282 NCO1, 1283 NLA111, 1286 SAU96, 12
87 HAE111, 1313 HAE11, 1314 HHA1,

```
     GlnAsnGluIleThrLeuThrHisProValThrLysTyrIleMetThrCysMetSerAla
1322 CAGAATGAAATCACCCTGACGCACCCAGTCACCAAATACATCATGACATGCATGTCGGCC
     GTCTTACTTTAGTGGGACTGCGTGGGTCAGTGGTTTATGTAGTACTGTACGTACAGCCGG
```

1332 HPH, 1339 HGA1, 1349 MAE3, 1350 HPH, 1363 NLA111, 1367
NSPC1, 1368 NLA111, 1369 AVA3 NSI1, 1371 NSPC1, 1372 NLA111,
1377 CFR1 XMA3, 1378 HAE111,

```
     AspLeuGluValValThrSerThrTrpValLeuValGlyGlyValLeuAlaAlaLeuAla
1382 GACCTGGAGGTCGTCACGAGCACCTGGGTGCTCGTTGGCGGCGTCCTGGCTGCTTTGGCC
     CTGGACCTCCAGCAGTGCTCGTGGACCCACGAGCAACCGCCGCAGGACCGACGAAACCGG
```

1384 ECOR11 SCRF1, 1385 GSU1, 1388 MNL1, 1394 MAE3, 1399 BSP
1286 HGIA, 1404 ECOR11 SCRF1, 1409 BSP1286 HGIA, 1419 FNU4H1
, 1421 AHA11, 1422 HGA1, 1426 ECOR11 SCRF1, 1430 BBV FNU4H1,
1437 CFR1, 1438 HAE111, 1439 FNU4H1, 1441 THA1,

```
     AlaTyrCysLeuSerThrGlyCysValValIleValGlyArgValValLeuSerGlyLys
1442 GCGTATTGCCTGTCAACAGGCTGCGTGGTCATAGTGGGCAGGGTCGTCTTGTCCGGGAAG
     CGCATAACGGACAGTTGTCCGACGCACCAGTATCACCCGTCCCAGCAGAACAGGCCCTTC
```

1453 HINC11, 1461 BBV FNU4H1, 1494 HPA11 NCI1 SCRF1, 1501 NA
E1,

```
     ProAlaIleIleProAspArgGluValLeuTyrArgGluPheAspGluMetGluGluCys
1502 CCGGCAATCATACCTGACAGGGAAGTCCTCTACCGAGAGTTCGATGAGATGGAAGAGTGC
     GGCCGTTAGTATGGACTGTCCCTTCAGGAGATGGCTCTCAAGCTACTCTACCTTCTCACG
```

1502 HPA11, 1528 MNL1, 1542 TAQ1, 1553 MBO11, 1558 BSP1286 H
GIA,

```
     SerGlnHisLeuProTyrIleGluGlnGlyMetMetLeuAlaGluGlnPheLysGlnLys
1562 TCTCAGCACTTACCGTACATCGAGCAAGGGATGATGCTCGCCGAGCAGTTCAAGCAGAAG
     AGAGTCGTGAATGGCATGTAGCTCGTTCCCTACTACGAGCGGCTCGTCAAGTTCGTCTTC
```

1563 DDE1, 1576 RSA1, 1581 TAQ1, 1590 FOK1, 1594 SFAN1, 1612

TTHIII2, 1621 HAEl11 SAU96,    FIG. 79D

```
       AlaLeuGlyLeuLeuGlnThrAlaSerArgGlnAlaGluValIleAlaProAlaValGln
1622   GCCCTCGGCCTCCTGCAGACCGCGTCCCGTCAGGCAGAGGTTATCGCCCCTGCTGTCCAG
       CGGGAGCCGGAGGACGTCTGGCGCAGGGCAGTCCGTCTCCAATAGCGGGGACGACAGGTC
```

1624 MNL1, 1628 HAE111, 1630 MNL1, 1634 PST1, 1639 TTHIII1, 1642 THA1, 1643 HGA1, 1658 MNL1,

```
       ThrAsnTrpGlnLysLeuGluThrPheTrpAlaLysHisMetTrpAsnPheIleSerGly
1682   ACCAACTGGCAAAAACTCGAGACCTTCTGGGCGAAGCATATGTGGAACTTCATCAGTGGG
       TGGTTGACCGTTTTTGAGCTCTGGAAGACCCGCTTCGTATACACCTTGAAGTAGTCACCC
```

1697 AVA1 XHO1, 1698 TAQ1, 1718 NDE1,

```
       IleGlnTyrLeuAlaGlyLeuSerThrLeuProGlyAsnProAlaIleAlaSerLeuMet
1742   ATACAATACTTGGCGGGCTTGTCAACGCTGCCTGGTAACCCCGCCATTGCTTCATTGATG
       TATGTTATGAACCGCCCGAACAGTTGCGACGGACCATTGGGGCGGTAACGAAGTAACTAC-
```

1762 HINC11, 1768 BBV FNU4H1, 1772 ECOR11 SCRF1, 1775 BSTE2, 1776 MAE3,

```
       AlaPheThrAlaAlaValThrSerProLeuThrThrSerGlnThrLeuLeuPheAsnIle
1802   GCTTTTACAGCTGCTGTCACCAGCCCACTAACCACTAGCCAAACCCTCCTCTTCAACATA
       CGAAAATGTCGACGACAGTGGTCGGGTGATTGGTGATCGGTTTGGGAGGAGAAGTTGTAT
```

1809 ALWN1 NSPB11 PVU11, 1810 ALU1, 1811 BBV FNU4H1, 1817 MAE3, 1818 HPH, 1836 MAE1, 1846 MNL1, 1849 MNL1, 1851 MBO11,

```
       LeuGlyGlyTrpValAlaAlaGlnLeuAlaAlaProGlyAlaAlaThrAlaPheValGly
1862   TTGGGGGGGTGGGTGGCTGCCCAGCTCGCCGCCCCGGTGCCGCTACTGCCTTTGTGGGC
       AACCCCCCCACCCACCGACGGGTCGAGCGGCGGGGGCCACGGCGATGACGGAAACACCCG
```

1877 BBV FNU4H1, 1884 ALU1, 1889 FNU4H1, 1895 NCI1 SCRF1, 1896 HPA11, 1898 BAN1 NLA1V, 1901 FNU4H1, 1919 HAE11, 1920 HHA1,

```
       AlaGlyLeuAlaGlyAlaAlaIleGlySerValGlyLeuGlyLysValLeuIleAspIle
1922   GCTGGCTTAGCTGGCGCCGCCATCGGCAGTGTTGGACTGGGGAAGGTCCTCATAGACATC
       CGACCGAATCGACCGCGGCGGTAGCCGTCACAACCTGACCCCTTCCAGGAGTATCTGTAG
```

1927 DDE1, 1930 ALU1, 1934 AHA11 BAN1 HAE11 NAR1 NLA1V, 1935 HHA1, 1937 FNU4H1, 1966 AVA2 SAU96, 1969 MNL1, 1978 FOK1,

```
       LeuAlaGlyTyrGlyAlaGlyValAlaGlyAlaLeuValAlaPheLysIleMetSerGly
1982   CTTGCAGGGTATGGCGCGGGCGTGGCGGGAGCTCTTGTGGCATTCAAGATCATGAGCGGT
       GAACGTCCCATACCGCGCCCGCACCGCCCTCGAGAACACCGTAAGTTCTAGTACTCGCCA
```

1995 HHA1, 1996 THA1, 2010 BAN11 BSP1286 HGIA SAC1, 2011 ALU1, 2021 BSM1, 2029 MBO1 SAU3A, 2032 NLA111, 2039 HPH,

```
       GluValProSerThrGluAspLeuValAsnLeuLeuProAlaIleLeuSerProGlyAla
2042   GAGGTCCCCTCCACGGAGGACCTGGTCAATCTACTGCCCGCCATCCTCTCGCCCGGAGCC
       CTCCAGGGGAGGTGCCTCCTGGACCAGTTAGATGACGGGCGGTAGGAGAGCGGGCCTCGG
```

2042 MNL1, 2044 AVA2 NLA1V SAU96, 2049 MNL1, 2057 MNL1, 2059 AVA2 SAU96, 2060 TTHIII1, 2062 ECOR11 SCRF1, 2083 FOK1, 2086 MNL1, 2093 NCI1 SCRF1, 2094 HPA11, 2096 NLA1V, 2097 BAN11 BSP1286, 2101 MNL1,

```
       LeuValValGlyValValCysAlaAlaIleLeuArgArgHisValGlyProGlyGluGly
2102   CTCGTAGTCGGCGTGGTCTGTGCAGCAATACTGCGCCGGCACGTTGGCCCGGGCGAGGGG
       GAGCATCAGCCGCACCAGACACGTCGTTATGACGCGGCCGTGCAACCGGGCCCGCTCCCC
```

2123 BBV FNU4H1, 2134 HHA1, 2136 NAE1, 2137 HPA11, 2142 MAE2, 2147 HAE111 SAU96, 2149 AVA1 NCI1 SCRF1 SMA1, 2150 HPA11 N

FIG. 79E

CI1 SCRF1, 2156 MNL1,

2162 AlaValGlnTrpMetAsnArgLeuIleAlaPheAlaSerArgGlyAsnHisValSer
GCAGTGCAGTGGATGAACCGGCTGATAGCCTTCGCCTCCCGGGGGAACCATGTTTCCCC
CGTCACGTCACCTACTTGGCCGACTATCGGAAGCGGAGGGCCCCCTTGGTACAAAGGGG

2172 FOK1, 2179 HPA11, 2196 MNL1, 2199 AVA1 NCI1 SCRF1 SMA1,
2200 HPA11 NCI1 SCRF1, 2205 NLA1V, 2210 NLA111,

2222

FIG. 80A　　　　Human 23

```
     GlyPheAlaAspLeuMetGlyTyrIleProLeuValGlyAlaProLeuGlyGlyArgAla
  1  GGCTTCGCCGACCTCATGGGGTACATACCGCTCGTCGGCGCCCCTCTTGGAGGCCGTGCC

ArgAlaLeuAlaHisGlyValArgValLeuGluAspGlyValAlaSnTyrAlaThrGlyAsn
 61  AGGGCCCTGGCGCACGGCGTCCGGGTTTTGGAAGACGGTGAACTATGCAACAGGAAC
                CG    A

LeuProGlyCysSerPheSerIlePheLeuLeuAlaLeuLeuSerCysLeuThrValPro
121  CTTCCTGGTTGCTCCTTCTCTTCTATCTTCCTTCTGGCCCTACTCTCTTGCCTGACCGTGCCC
                                            GA        T

AlaSerAlaTyrGlnValArgAsnSerThrGlyLeuTyrHisValThrAsnAspCysPro
181  GCTTCAGCCTACCAAGTGCGCAACTCTACGGGGCTTTACCATGTCACCAATGATTGCCCT

AsnSerIleValTyrGluAlaValTyrArgValTyrGluAlaLeuHisAlaProGlyCysValPro
241  AACTCGAGTATTGTGTACGAGGCGGTCTATCGGGTCTACGAGGCTCTCCACGCTCCGGGGTGTCCCT
                                                        C

CysValArgGluAspAsnValSerArgCysTrpValAlaValThrProThrValAlaThr
301  TGCGTTCGCGAGGATAACGTCTCGAGATGTTGGGTGGCGGTGACCCCACGGTGGCCACC
              G                                             T

LysAspGlyLysLeuProThrThrGlnLeuArgArgHisIleAspLeuArgArgHisGlySer
361  AAGGACGGCAAACTCCCCACAACGCAGCTTCGACGTCACATCGATCTGCTTGTCGGGAGC
                                                              C    A

AlaThrLeuCysSerAlaLeuTyrValGlyAspLeuCysGlySerIlePheLeuValGly
421  GCCACCCTCTGCTCGGCCCTCTACGTGGGGGACCTTTGCGGGTCCATCTTTCTTGTCGGT
                                      T

GlnLeuPheThrPheSerProArgArgHisTrpThrThrGlnAspCysAsnCysSerIle
481  CAACTGTTTACCTTCTCTCCCAGGCGCCACTGGACGACGCAGGACTGCAACTGTTCTATC
                                                              C
```

FIG. 80B

```
     TyrProGlyHisIleThrGlyHisArgMetAlaTrpAspMetMetMetAsnTrpSerPro
541  TATCCGGCCATATAACGGTCACCGGCATGGCATGGATGATGATGAATGGAACTGTCCCT
                                                      G

ThrAlaAlaLeuValAlaValAlaGlyLeuLeuLeuArgIleProGlnAlaIleLeuAspMetIle
601  ACGGGGCATTGGTAGTAGCTCAGCTGCTCCGATCCACAAGCCATCTTGGACATGATC

AlaGlyAlaHisTrpGlyValLeuAlaGlyMetAlaTyrPheSerMetValGlyAsnTrp
661  GCTGGTGCTCACTGGGGAGTCCTGGCGGGCATGGCTTATTTCTCCATGGTGGGAACTGG
              G  AG                                G

AlaLysValLeuValAlaLeuLeuLeuPheAlaGlyValAlaAspAlaGluThrHisArgThr
721  GCGAAGTCCTGGTAGTCGCTGCTTCTATTTGCCGGTCGACGCGGAAACCACCGTACC
                                                    G

GlyGlySerAlaAlaArgSerThrAlaGlyValAlaSerLeuPheThrProGlyAlaArg
781  GGGGGAAGTGCCGCCCGCAGCAGTGCTAGTCTCTTCACCAGGCGCTAGG
                 T     A

GlnAsnIleGlnLeuIleAsnSerTrpHisIleAsnSerThrAlaLeuAsn
841  CAGAACATCCAGCTGATCAACAGCTGGCACATCAATAGTACGGCCTTGAAC
     C                                                   AT

CysAsnAspSerLeuThrThrGlyTyrTrpLeuAlaGlyLeuGlyLeuPheTyrHisHisLysPheAsn
901  TGCAATGACAGCCTTACCACCGGGTACTGGCTTAGCCTTTTCTATCACCATAAATTCAAC
     A                                                    A

SerSerGlyCysProGluArgLeuAlaSerCysArgProLeuThrAspPheAlaGln
961  TCTTCAGGCTGTCCCGAGAGGTTGGCCAGCTGCCGACCCCTCACCGATTTTGCCCAGG
     G  A                                                    G
```

FIG. 81A    Human 27

```
      GlyPheAlaAspLeuMetGlyTyrIleProLeuValGlyAlaProLeuGlyGlyAlaAla
  1   GGCTTCGCCGACCTCATGGGGTACATTCCGCTCGTCGGCGCTCCTCTTGGGGGCGCTGCC

ArgAlaLeuAlaHisGlyValArgValLeuGluAspGlyValAsnTyrAlaThrGlyAsn
 61   AGGGCCCTGGCGCATGGCGTCCGGGTTCTGGAAGACGGCGTGAACTATGCAACAGGGAAC

LeuProGlyCysSerPheSerIlePheLeuLeuAlaLeuLeuSerCysLeuThrValPro
121   CTTCCTGGTTGCTCTTTCTCTATCTTCCTGCTCTGCTCTTGTCCCTGCCTGACCGTGCCC

AlaSerAlaTyrGlnValArgAsnSerSerGlyIleTyrHisValThrAsnAspCysPro
181   GCATCGGCCTACCAAGTACGCAACTCCTCGGGCATTTACCATGTCACCAATGATTGCCCT

AsnSerSerIleValTyrGluThrAlaAspThrIleLeuHisSerProGlyCysValPro
241   AATTCGAGTATTGTGTACGAGACGGCCGACACCATCCTACACTCTCCGGGGTGTGTCCCT
                     C

CysValArgGluGlyAsnAlaSerLysCysTrpValProValAlaProThrValAlaThr
301   TGCGTTCGCGAGGGTAACGCCTCGAAATGTTGGGTGCCGGTAGCCCCCACAGTGGCCACC
                       G

ArgAspGlyAsnLeuProAlaThrGlnLeuArgArgHisIleAspLeuLeuValGlySer
361   AGGGACGGCAACCTCCCCGCAACGCTTCGACGTCACATCGATCTGCTTGTCGGGAGT
                          G              G

AlaThrLeuCysSerAlaLeuTyrValGlyAspLeuCysGlySerValPheLeuValGly
421   GCCACCCTTTGCTCGGCCCTCTATGTGGGGGACTTGTGCGGGTCTGTCTTTCTTGTCGGT
                   C                                      C

GlnLeuPheThrPheSerProArgArgHisTrpThrThrGlnAspCysAsnCysSerIle
481   CAACTGTTCACTTTCTCCCCCAGGCGCCACTGGACAACGCAAGATTGCAACTGCTCTATC
                                                              A
```

FIG. 81B

```
541  TyrProGlyHisIleThrGlyHisArgMetAlaTrpAspMetMetAsnTrpSerPro
     TACCCCGGCCATATAACGGGACACCGCATGGCATGGGATATGATGAACTGGTCCCCT

601  ThrAlaAlaLeuValMetAlaGlnLeuLeuArgIleProGlnAlaIleLeuAspMetIle
     ACAGCAGGCTGGTAATGGCTCAGCTGCTCAGGATCCCGCAAGCCATCTTGGACATGATC
                                                              G

661  AlaGlyAlaHisTrpGlyValLeuAlaGlyIleAlaTyrPheSerMetValGlyAsnTrp
     GCTGGTGCTCACTGGGGAGTCCTAGCGGGCATAGCGTATTTCTCCATGGTGGGAACTGG

721  AlaLysValLeuValValLeuLeuLeuPheAlaGlyValAspAlaThrThrTyrThrThr
     GCGAAGGTCCTGGTGGTGCTGTTGCTGTTTGCCGGCGTCGATGCGACAACCTATACCACC

781  GlyGlyAsnAlaAlaArgThrThrGlnAlaLeuThrSerPhePheSerProGlyAlaLys
     GGGGGAAATGCTGCCAGGACCACGCAGGCGCTCACCAGTTTTTTCAGCCCAGGCGCCAAG

841  GlnAspIleGlnLeuIleAsnThrAsnGlySerTrpHisIleAsnArgThrAlaLeuAsn
     CAGGATATCCAGCTGATCAACACGAACGGGTCCTGGCACATCAATCGCACGGCCTTGAAC
                                             T

901  CysAsnAlaSerLeuAspThrGlyTrpValAlaGlyLeuPheTyrTyrHisLysPheAsn
     TGTAATGCGAGCCTCGACACTGGCTGGGTAGCGGGGCTCTCTTATTACCACAAATTCAAC
                                     G

961  SerSerGlyCysProGluArgMetAlaSerCysArgProLeuAlaAspPheAspGln
     TCTTCAGGCTGCCCCGAGAGGATGGCCAGCTGTAGGCCCCTTGCCGATTTCGACCAGG
                                                             C
```

FIG. 82A

```
1. human 27    2. HCV 1    3. human 23

1 CGGCTTCGCCGACCTCATGGGGTACATtCCGCTCGTCGGCGCtCCTCTTGGgGGCGCTGCCAGGGCCCTGGC
    ********************************************************************
  1 CGGCTTCGCCGACCTCATGGGGTACATACCGCTCGTCGCGCCCCTCTTGGAGGCGCTGCCAGGGCCCTGGC
    ********** ****************** *****  *******************************
  1 CGGCTTCGCCGACCTCATGGGGTACATACCGCTCGGCGCCCCTCTTGGCGGCGCCgTGCCAGGGCCCTGGC

73 GCATGGCGTCCGGGTTCTGGAAGACGGCGTGAACTATGCAACAGGGAACCTTCCTGGTTGCTCTTTCTCTAT
    *************************************************************** ******
 73 GCATGGCGTCCGGGTTCTGGAAGACGGCGTGAACTATGCAACAGGGAACCTTCCTGGTTGCTCTTTTCTCTAT
    *  ************************************************************* ******
 73 GCAcGGCGTCCGGGTTtGGAAGACGGCGTGAACTATGCAACAGGGAACCTTCCTGGTTGCTCcTTtTCTAT

145 CTTCCTTCTGGCtCTGCTCTCTTGCCTGACCGTGCCCGCaTCGGCCTACCAAGTaCGCAACTCCtCGGcaT
    **** ****** ************ *********** *********************** ****    *
145 CTTCCTTCTGCCCCTCTGCTCTCTTGCTGACtGTGCCCGCTTCGGCCTACCAAGTGCGCAACTCCACGGGCT
    ***  ****** ************ *****a ******************************* *******
145 CTTCCTTCTGGCCCTaCTCTCTTGCCtGACCGTGCCCGCTTCaGCCTACCAAGTGCGCAACTCtACGGGCT

217 TTACCAtGTCACCAATGATTGCCCTAATTCGAGTATTGTACGAGAcGGCCGACaCCATCCTaCACtCTCC
    *******  *************  ****  ****************  ***** ******* ***  ***
217 TTACCAcGTCACCAATGATTGCCCTAACTGCGAGTATTGTACGAGGCGGCCGATGCCATCCTGCACaCTCC
    ******* **************  ******* *************  *******  ************ **
217 TTACCAtGTCACCAATGATTGCCCTAaCTCTTGCCTGACCGTGAGGCGGCCGATGCCATCCTGCACgCTCC

289 GGGGTGtGTCCCTTGCGTTCGTGAGGGtAACGCCCTCGAAaTGTTGGGTGCCGgTagCCCCACaGTGCCAC
    ***** *********** *     *  ********** ***   ** ****** *** ** ** *******
289 GGGGTGCGTCCCTTGCAACGCCCTCGtGAGGGCAACGCCCTCGAGGTGTTGGGTGCCGATGACCCtACGGCCAC
    ****** ********* *  *    *  ********** ** ********** ***  ****  ********
289 GGGGTGtGTCCCTTGCGTTCGtGAGGAtAACGtCTCGAGaTGTTGGGTGGCGGtGACCCCACGGTGCCAC
```

FIG. 82B

```
361  CAGGGAcGGCAAcCTCCCCGCaACGCAGCTTCGACGTCACATCGATCTGCTTGTCGGAGtGCCACCTtTG
     ****** **** ****** * ******** * ****************** ***** ***** *****
361  CAGGGAtGCAAACTCCCCGCgACGCAGCTTCGACGTCACATCGATCTGCTTGTCGGAGCGCCACCCTCTG
     ** *** ***** *** * ******** * ***************** ***** **** **** ***
361  CAaGGACGGCAAACTCCCCaCaACGCAGCTTCGACGTCACATCGATCTGCTTGTCGGAGCGCCACCCTCG

433  CTCGGCCCCTCTATGTGGGGACTTGTGCGGTCTGTCTTTCTGTCGGtCAACTGTTCACTTTCTCCCCAG
     ***** ******** ***** ******** *** * * ** * ** ** ****** ** * *****
433  tTCGGCCCCTCTACGTGGGGACCTGTGCGGGTCTGTGCGGCCAACTGTTCACTTCTCTCCCAG
     **** ******** ******** ****** ** * ******** ** ***** * ***** *****
433  CTCGGCCCCTCTACGTGGGGACCTTGTGGGGTCCaTCTTTCTGTGGtCAACTGTTCTGTTtACTTCTCTCCCAG

505  GCGCCACTGACAACGCAAGATTGCAAcTGCTCTATCTACCCCGGCCATATAACGGAcACCGCATGCATG
     ***** ****** ** ****** * * ** ** * **** ** ** ********
505  GCGCCACTGACGACGCAAGgTTGCAAtGCTCAATGCTCTATCTATCCGGCCATATAACGGTCACCGCATGCATG
     ****** ****** * ** ***** ** ** * ** *************** ***** *******
505  GCGCCACTGGACGACGCAgACTGCAAACTGCAACTGTCTTCTATCTATCCGGCCATATAACGGTCACCGCATGCATG

577  GGATATGATGATGAACTGTCCCCTACAgCAGCGCTGGTAATGGCTCAGCTGCTCaGGATCCCgCAAGCCAT
     ****** ******** ** ******** * *
577  GGATATGATGATGAACTGTCCCCTACGaCGGGCGTTGGTAATGGCTCAGCTGCTCCGATCCCACAAGCCAT
     ****** ******** ****** **** ****** ************** ****
577  GGATATGATGATGAACTGTCCCCTACGgCGGCATTGGTAgTaGCTCAGCTGCTCCGATCCCACAAGCCAT

649  CTTGGACATGATCGCTGGTGTGCTGCTGCTTAgCGGGCATAGCGTATTTCTCCATGGTGGGAACTG
     ** ***** * * *** ** *** *** ***** ** ********
649  CTTGGACATGATCGCTGGTgTGCTGtTTGCCGGCGTCAGTGGGAGTCCTGGCGGGAGTCCTAGCGGCATAGCGTATTCTCCATGGTGGGAACTG
     ** ***** ***** * * **** ****** **** ********
649  CTTGGACATGATCGCTGGTCTCACTGGCGGGAGTCCTGGCGGGCATGCGTATTCTCCATGGTGGGAACTG

721  GGCGAAGGTCCTGGTAGTGCTGCTATTGCCGGGACCGGCGTCCGGCGTCGACGCGGAAACCGACaAACCTacACCGGGGAATGC
     *** ** * * *** **** ** *** ****** **** ****
721  GGCGAAGGTCCTGGTAGTGCTGCTATTGCCGGCGTCCGGCGTCGACGCGGAAACCGACgtCACCGGGGAAGTGC
     ****** ** *** * * * *** *
721  GGCGAAGGTCCTGGTAGTGCTGCTtCTATTGCCGGCGTCGACGCGGAAACCGACCACCGTACCGGGGAAGTGC
```

```
793  tGcCaggACcacGcagGcgcTcaccAGtTtTtTCagcCCAGGCGCCAAGCGCCAGGAtaTCCAGCTGATCAACAC
          *              *            **  *                 *          *         *
793  CGgCCaCaCtgtGtCTGGAtTTGtTAGcCTCcTCgCACCAGGCGCCAAGCGCCAGGAACgTCCAGCTGATCAACAC
       *          *    *                 ***                     *
793  CGcCCgCAgcacGgCTGGAgTTGcTAGtCTCtTCaCACCAGGCGCCtAGGCAGAACaTCCAGCTGATCAACAC 865  CAACGGCAGTTGGCACaTCAATcGCACGGCCtTGAACTGtAATGcGAGCCCTCgACaCTgGGCTGGGtTaGCgGG
                                                   *  *                    *
865  CAACGGCAGTTGGCACCtCAATAGCACGGCCCtTGAACTGCAATGATAGCCTCAACACCGGGCTGTTgGCaGG
                                                *  *         *              *
865  CAACGGCAGTTGGCACaTCAATAGtACGGCCtTGAACTGCAATGACAGCCCTtACCACCGGGCTGTTAGCgGG 937  GCTcTTCTATtACCACAAaTTCAACTCTTCAGGCTGcCCGAGAGGaTGCCCAGCTGtaGGCCCCTTgCCGA
          *         *                        **                   *
937  GCTTTTCTATCACCACAAgTTCAACTCTTCAGGCTGTCCtGAGAGGCTaGCCAGCTGCCGACCCCTTACCGA
        *          *                          *      *             *       *
937  GCTTTTCTATCACCAtAAaTTCAACTCTTCAGGCTGTCCGAGAGGTTGGCCAGCTGCCGACCCCTCACCGA 1009 TTTcGACCAGG
         *
1009 TTTTGACCAGG
        *
1009 TTTTGcCCAGG
```

```
  1 GFADLMGYIPLVGAPLGGAARALAHGVRVLEDGVNYATGNLPGCSFSIFLLALLSCLTVPASAYQVRNSsGi       1. human 27
    ************************************************************************ *    2. HCV 1
  1 GFADLMGYIPLVGAPLGGAARALAHGVRVLEDGVNYATGNLPGCSFSIFLLALLSCLTVPASAYQVRNSTGL       3. human 23
  1 GFADLMGYIPLVGAPLGGIrARARALAHGVRVLEDGVNYATGNLPGCSFSIFLLALLSCLTVPASAYQVRNSTGL 73 YHVTNDCPNSSIVYEtADtILHsPGCVPCVREGNASkCWVpvaPTVATRDGnLPATQLRRHIDLLVGSATLC
    *  ****************  * ***** *   ***  *** ********* *
 73 YHVTNDCPNSSIVYEAADAILHtPGCVPCVREGNASRCWVAmTPTVATRDGKLPATQLRRHIDLLVGSATLC
 73 YHVTNDCPNSSIVYEAADAILHaPGCVPCVREdNvSRCWVAvTPTVATkDGKLPtTQLRRHIDLLVGSATLC 145 SALYVGDLCGSVFLVGQLFTFSPRRHWTTQdCNCSIYPGHITGHRMAWDMMMNWSPTaALVMAQLLRIPQAI
    ***** *************      ******************** ************ *
145 SALYVGDLCGSVFLVGQLFTFSPRRHWTTQgCNCSIYPGHITGHRMAWDMMMNWSPTtALVMAQLLRIPQAI
145 SALYVGDLCGSiFLVGQLFTFSPRRHWTTQdCNCSIYPGHITGHRMAWDMMMNWSPTaALVvAQLLRIPQAI 217 LDMIAGAHWGVLAGIAYFSMVGNWAKVLVVLLIFAGVDAtTytTGGnAarTtqalTsFfsPGAKQdiQLINT
    *********************************** *     *** * ** *  *  * **  *** *
217 LDMIAGAHWGVLAGIAYFSMVGNWAKVLVVLLIFAGVDAETHVTGGSAghTvsGfvSLLaPGAKQNVQLINT
217 LDMIAGAHWGVLAGmAYFSMVGNWAKVLVVLLIFAGVDAETHrTGGSAarstaGvaSLftPGArQNiQLINT 289 NGSWHiNrTALNCNaSLdTGWvAGLFYHKFNSSGCPERmASCRPLaDFDQ
    ****** * ****** * * *********** ** * *
289 NGSWHlNSTALNCNDSLnTGWLAGLFYHKFNSSGCPERLASCRPLIDFDQ
289 NGSWHiNSTALNCNDSLtTGWLAGLFYHHKFNSSGCPERLASCRPLIDFaQ
```

FIG. 85A 1. ssThorn#8.r  (1-587)
2. ssEC1#2.r    (1-587)
3. ssHCT18#7.r  (1-587)
4. env1.hcv     (1-1657)

FIG. 85B

```
147 TATGCAACAGGGAACCTTCCTGGTTGCTCTCTTTCTcTcTCTTGGCCcTGCTCTCTTGtcTGACcGTG———
147 TATGCAACAGGGAACCTTCCTGGTTGCTCTCTTTCTCTTCCTTGGCCTGCTCTCTTGACTGTG———
147 TATGC   CAGGGAACCTTCCTGGTTGCTCTCTTTCTtTATCTTCCTTGGCCtGCTCTCTTGCtTGACTGTG———
505 TATGCAACAGGGAACCTTCCTGGTTGCTCTCTTTCTCTATCTTCCTTGGCCCTGCTCTCTTGCCTGACTGTG———
219 CCCGCTTCAGCCTACCAAGTGCGCAACTCCaCGGGGCTTTACCATGTCACCAACGATTGCCCAACTCGAGt———
219 CCCGCTTCAGCCTACCAAGTGCGCAACTCCtCGGGGCTTTACCATGTCACCAATGATTGCCCtAACTCGAGc———
219 CCCGCTTCAGCCTACCAAGTGCGCAACTCCACGGGGCTTTACCATGTCACCAATGATTGCCCAACTCGAGT———
577 CCCGCTTCGgCCTACCAAGTGCGCAACTCCACGGGGCTTTACCACGTCACCAATGATTGCCCtAACTCGAGT———
291 ATTGTGTACGAGGCGGCCGATGCtATCCTGCACgCTCCGGGTGTGTCCCTTGCGTTCCCTTGCGTTCgCGAGGGtAACGcC———
291 ATTGTGTACGAGGCGGCCGATGCCCGATGCCGACGCGCCATCCTGCACACTCCGGGTGTGTCCCTTGCGTTCACGAGGCAACGTC———
291 ATTGTaTACGAaGCGGCCGACGCGGCCATCCTGCACACTCCGGGTGTGTCCCTTGCGTTCACGAGGCAACGTC———
649 ATTGTgTACGAgGCGGCCGAtGCCATCCTGCACACTCCGGGTGCGTCCCTTGCGTTCgtGAGGCAACGcC———
363 TCGAGGTGTTGGGTGGCCGATGACCCCACGGTGGCCgCCAGGaCGGCAgACTCCCCACAACGCAGCTgCGA———
363 TCGAGGTGTTGGGTGGCCGATGACCCCACGGTGGCCACCAGGgCGGCAAACTCCCACAACGCAGCTTCGA———
363 TCGAGGTGTTGGGTGGCGgTGACCCCACGGTGGCCACCAGGATGGCCAAACTCCCACAACGCAGCTTCGA———
721 TCGAGGTGTTGGGTGGCCGATGACCCtACGGTGGCCACCCCTACGGTGGCCACCAGGATGGCCAAACTCCCCgCgACGCAGCTTCGA———
```

FIG. 85C

```
                  10        20        30        40
         GAATTCGGACGACGCAAGGTTGCAATTGCTCTATCTATCCCGGCCATAT
         X:::::::::::::::::::::::::::::::::::::::::::::::
/SSp     CTCTCCCAGGCGCCACTGGACGACGCAAGGTTGCAATTGCTCTATCTATCCCGGCCATAT
        550       560       570       580       590       600

50        60        70        80    A    90       100
   AACAGGTCACCGCATGGCATGGGATATGATGATGAACTGGTCCCCTACGACGGCGTTAGT
   :::  :::::::::::::::::::::::::::::::::::::::::::::::::::  ::
   AACGGGTCACCGCATGGCATGGGATATGATGATGAACTGGTCCCCTACGACGGCGTTGGT
      610       620       630       640       650       660

110       120       130       140       150       160
  GGTAGCTCAGCTGCTCCGGATCCCACAAGCCATCTTGGACATGATCGCTGGTGCTCACTG
    : :::::::::::::::::::::::::::::::::::::::::::::::::::::::::
  AATGGCTCAGCTGCTCCGGATCCCACAAGCCATCTTGGACATGATCGCTGGTGCTCACTG
     670       680       690       700       710       720

170       180       190       200       210       220
   GGGAGTCCTGGCGGGCATAGCGTATTTCTCCATGGTGGGGAACTGGGCGAAGGTCTTGGC
   ::::::::::::::::::::::::::::::::::::::::::::::::::::::::: :::
   GGGAGTCCTGGCGGGCATAGCGTATTTCTCCATGGTGGGGAACTGGGCGAAGGTCCTGGT
      730       740       750       760       770       780

230       240       250       260       270       280
   AGTGCTGCTGCTATTTGCCGGCGTCGACGCGGAAACCCACGTCACTGGGGGGATCGCCGC
   ::::::::::::::::::::::::::::::::::::::::::::::: :::::  :  ::::
   AGTGCTGCTGCTATTTGCCGGCGTCGACGCGGAAACCCACGTCACCGGGGGAAGTGCCGG
      790       800       810       820       830       840

290       300       310       320       330       340
   CAAAACTACGGCTAGCCTTACTGGTCTCTTCAATTTAGGTGCCAAGCAGAACATCCAGCT
   : :  : :::  ::  :  :  :  : :::   :::  :::::::::::::::  :::::
   CCACACTGTGTCTGGATTTGTTAGCCTCCTCGCACCAGGCGCCAAGCAGAACGTCCAGCT
      850       860       870       880       890       900

350       360       370       380       390       400
   GATCAACACCAACGGCAGTTGGCACATCAACAGGACGGCCTTGAACTGCAATGATAGCCT
   :::::::::::::::::::::::::  :::: ::  :::::: :::::::::::::::::
   GATCAACACCAACGGCAGTTGGCACCTCAATAGCACGGCCCTGAACTGCAATGATAGCCT
      910       920       930       940       950       960

410       420
   CAACACCGGCTGGAATTC
   ::::::::::::::::X
   CAACACCGGCTGGTTGGCAGGGCTTTTCTATCACCACAAGTTCAACTCTTCAGGCTGTCC
      970       980       990      1000      1010      1020
```

FIG. 86

AA #117-308 (putative envelope region)    FIG. 87

1) HCT #18 (USA)       3 clones sequenced
2) JH23 (USA)          ?
3) JH 27 (USA)         ?
4) PBL-Th (USA)        2 clones sequenced
5) EC1 (Italy)         3 clones sequenced
6) HCV-1 (chimpanzee)  multiple

```
      C/M←┬→S
1)            (P)
2)
3)
4)
5)
6)RNLGKVIDTLTCGFADLMGYIPLVGAPLGGAARALAHGVRVLEDGVNYATGNL

1)                        H
2)
3)                              S              T    T
4)       L
5)     (F)                      S
6)PGCSFSIFLLALLSCLTVPASAYQVRNSTGLYHVTNDCPNSSIVYEAADAILH

Y
1)     (H)    V       V              T
2)A         D V       V        K     T
3)S             P V A          N
4)A                        A   R     T
5)          H V                      T
6)TPGCVPCVREGNASRCWVAMTPTVATRDGKLPATQLRRHIDLLVGSATLCS 1)
2)          I             D
3)                        D
4)
5)          I
6)ALYVGDLCGSVFLVGQLFTFSPRRHWTTQGCNCSI
```

SUMMARY: "S" AA117-308 (93%)

HCT#18, PBL-Th, EC1(Italy) have 97% homology with HCV-1
JH23 and JH 27 have 96% and 95% homology with HCV-1, respectively AA#300-438 ( C-terminal region of the putative envelope region and amino ~1/3 of NS1)

1) JH23                              ?
2) JH27                              ?
3) Japanese isolate (T. Miyamura)    ?
4) EC10 (Italy)                      2 clones sequenced
                                     (one nt difference, which did not
                                     result in an amino acid change)
5) HCV-1 (chimpanzee)                multiple

S ←─┬─→ NS I

1)  D                       A   V
2)  D                       A
3)                              V S        VM  V
4)
5) TTQGCNCSIYPGHITGHRMAWDMMMNWSPTTALVMAQLLRIPQAILDMIAGA

1)    M                        R      A RST A  VA
2)                           T YT    N A R  TQALT  F
3)    L  Y              I M    GH R    VQ   VT  TLT
4)                    A                I AK  TASLTA
5) HWGVLAGIAYFSMVGNWAKVLVVLLLFAGVDAETHVTGGSAGHTVSGFVSL

1) FS   R  I        I          T    V
2) FT     D I       I R       A D
3) FR   S KI  V     I R         Q  F
4) FNL    I         I R             N
5) LAPGAKQNVQLINTNGSWHLNSTALNCNDSLNTGWL

SUMMARY: NS 1 AA 330-660

| "Isolate"    | %Homology (AA330-438) | %Homology (AA383-405) |
|--------------|-----------------------|-----------------------|
| JH23         | 83                    | 57                    |
| JH27         | 80                    | 39                    |
| Japanese     | 73                    | 48                    |
| EC10 (Italy) | 84                    | 48                    |

```
                                5'terminus------------------------
CACTCCACCATGAATCACTCCCCTGTGAGGAACTACTGTCTTCACGCAGAAAGCGTCTAG
CCATGGCGTTAGTATGAGTGTCGTGCAGCCTCCAGGACCCCCCCTCCCGGGAGAGCCATA
GTGGTCTGCGGAACCGGTGAGTACACCGGAATTGCCAGGACGACCGGGTCCTTTCTTGGA
TCAACCCGCTCAATGCCTGGAGATTTGGGCGTGCCCCCGCAAGACTGCTAGCCGAGTAGT
GTTGGGTCGCGAAAGGCCTTGTGGTACTGCCTGATAGGGTGCTTGCGAGTGCCCCGGGAG-300
```

(Putative initiator methionine codon)
```
            |                              G      C
GTCTCGTAGACCGTGCACCATGAGCACGAATCCTAAACCTCAAAAAAAAAACAAACGTAA
CACCAACCGTCGCCCACAGGACGTCAAGTTCCCGGGTGGCGGTCAGATCGTTGGTGGAGT
TTACTTGTTGCCGCGCAGGGGCCCTAGATTGGGTGTGCGCGCGACGAGAAAGACTTCCGA
GCGGTCGCAACCTCGAGGTAGACGTCAGCCTATCCCCAAGGCTCGTCGGCCCGAGGGCAG
GACCTGGGCTCAGCCCGGGTACCCTTGGCCCCTCTATGGCAATGAGGGCTGCGGGTGGGC-600
GGGATGGCTCCTGTCTCCCCGTGGCTCTCGGCCTAGCTGGGGCCCCACAGACCCCCGGCG
TAGGTCGCGCAATTTGGGTAAGGTCATCGATACCCTTACGTGCGGCTTCGCCGACCTCAT
GGGGTACATACCGCTCGTCGGCGCCCCTCTTGGAGGCGCTGCCAGGGCCCTGGCGCATGG
CGTCCGGGTTCTGGAAGACGGCGTGAACTATGCAACAGGGAACCTTCCTGGTTGCTCTTT C
CTCTATCTTCCTTCTGGCCCTGCTCTCTTGCTTGACTGTGCCCGCTTCGGCCTACCAAGT-900
GCGCAACTCCACGGGGCTTTACCACGTCACCAATGATTGCCCTAACTCGAGTATTGTGTA
CGAGGCGGCCGATGCCATCCTGCACACTCCGGGGTGCGTCCCTTGCGTTCGTGAGGGCAA
CGCCTCGAGGTGTTGGGTGGCGATGACCCCTACGGTGGCCACCAGGGATGGCAAACTCCC
CGCGACGCAGCTTCGACGTCACATCGATCTGCTTGTCGGGAGCGCCACCCTCTGTTCGGC
CCTCTACGTGGGGGACCTATGCGGGTCTGTCTTTCTTGTCGGCCAACTGTTCACCTTCTC-1200
TCCCAGGCGCCACTGGACGACGCAAGGTTGCAATTGCTCTATCTATCCCGGCCATATAAC G
GGGTCACCGCATGGCATGGGATATGATGATGAACTGGTCCCCTACGACGGCGTTGGTAAT
GGCTCAGCTGCTCCGGATCCCACAAGCCATCTTGGACATGATCGCTGGTGCTCACTGGGG
AGTCCTGGCGGGCATAGCGTATTTCTCCATGGTGGGGAACTGGGCGAAGGTCCTGGTAGT
GCTGCTGCTATTTGCCGGCGTCGACGCGGAAACCCACGTCACCGGGGGAAGTGCCGGCCA-1500
CACTGTGTCTGGATTTGTTAGCCTCCTCGCACCAGGCGCCAAGCAGAACGTCCAGCTGAT
CAACACCAACGGCAGTTGGCACCTCAATAGCACGGCCCTGAACTGCAATGATAGCCTCAA
CACCGGCTGGTTGGCAGGGCTTTTCTATCACCACAAGTTCAACTCTTCAGGCTGTCCTGA
GAGGCTAGCCAGCTGCCGACCCCTTACCGATTTTGACCAGGGCTGGGGCCCTATCAGTTA
TGCCAACGGAAGCGGCCCCGACCAGCGCCCCTACTGCTGGCACTACCCCCAAAACCTTG-1800
CGGTATTGTGCCCGCGAAGAGTGTGTGTGGTCCGGTATATTGCTTCACTCCCAGCCCCGT
GGTGGTGGGAACGACCGACAGGTCGGGCGCGCCCACCTACAGCTGGGGTGAAAATGATAC
GGACGTCTTCGTCCTTAACAATACCAGGCCACCGCTGGGCAATTGGTTCGGTTGTACCTG
GATGAACTCAACTGGATTCACCAAAGTGTGCGGAGCGCCTCCTTGTGTCATCGGAGGGGC
GGGCAACAACACCCTGCACTGCCCCACTGATTGCTTCCGCAAGCATCCGGACGCCACATA-2100

C
CTCTCGGTGCGGCTCCGGTCCCTGGATCACACCCAGGTGCCTGGTCGACTACCCGTATAG
GCTTTGGCATTATCCTTGTACCATCAACTACACCATATTTAAAATCAGGATGTACGTGGG
AGGGGTCGAACACAGGCTGGAAGCTGCCTGCAACTGGACGCGGGGCGAACGTTGCGATCT
GGAAGACAGGGACAGGTCCGAGCTCAGCCCGTTACTGCTGACCACTACACAGTGGCAGGT
CCTCCCGTGTTCCTTCACAACCCTACCAGCCTTGTCCACCGGCCTCATCCACCTCCACCA-2400
GAACATTGTGGACGTGCAGTACTTGTACGGGGTGGGGTCAAGCATCGCGTCCTGGGCCAT
TAAGTGGGAGTACGTCGTTCTCCTGTTCCTTCTGCTTGCAGACGCGCGCGTCTGCTCCTG
CTTGTGGATGATGCTACTCATATCCCAAGCGGAGGCGGCTTTGGAGAACCTCGTAATACT
TAATGCAGCATCCCTGGCCGGGACGCACGGTCTTGTATCCTTCCTCGTGTTCTTCTGCTT
TGCATGGTATTTGAAGGGTAAGTGGGTGCCCGGAGCGGTCTACACCTTCTACGGGATGTG-2700
GCCTCTCCTCCTGCTCCTGTTGGCGTTGCCCCAGCGGGCGTACGCGCTGGACACGGAGGT
GGCCGCGTCGTGTGGCGGTGTTGTTCTCGTCGGGTTGATGGCGCTGACTCTGTCACCATA
TTACAAGCGCTATATCAGCTGGTGCTTGTGGTGGCTTCAGTATTTTCTGACCAGAGTGGA
AGCGCAACTGCACGTGTGGATTCCCCCCCTCAACGTCCGAGGGGGGCGCGACGCCGTCAT
```

FIG. 89B

```
CTTACTCATGTGTGCTGTACACCCGACTCTGGTATTTGACATCACCAAATTGCTGCTGGC-3000
CGTCTTCGGACCCCTTTGGATTCTTCAAGCCAGTTTGCTTAAAGTACCCTACTTTGTGCG
CGTCCAAGGCCTTCTCCGGTTCTGCGCGTTAGCGCGGAAGATGATCGGAGGCCATTACGT
GCAAATGGTCATCATTAAGTTAGGGGCGCTTACTGGCACCTATGTTGTTTATAACCATCTCAC
TCCTCTTCGGGACTGGGCGCACAACGGCTTGCGAGATCTGGCCGTGGCTGTAGAGCCAGT
CGTCTTCTCCCAAATGGAGACCAAGCTCATCACGTGGGGGGCAGATACCGCCGCGTGCGG-3300
TGACATCATCAACGGCTTGCCTGTTTCCGCCCGCAGGGGCCGGGAGATACTGCTCGGGCC
AGCCGATGGAATGGTCTCCAAGGGGTGGAGGTTGCTGGCGCCCATCACGGCGTACGCCCA
GCAGACAAGGGGCCTCCTAGGGTGCATAATCACCAGCCTAACTGGCCGGGACAAAAACCA
AGTGGAGGGTGAGGTCCAGATTGTGTCAACTGCTGCCCAAACCTTCCTGGCAACGTGCAT
CAATGGGGTGTGCTGGACTGTCTACCACGGGGCCGGAACGAGGACCATCGCGTCACCCAA-3600
                                                     T
GGGTCCTGTCATCCAGATGTATACCAATGTAGACCAAGACCTTGTGGGCTGGCCCGCTCC

C
GCAAGGTAGCCGCTCATTGACACCCTGCACTTGCGGCTCCTCGGACCTTTACCTGGTCAC
GAGGCACGCCGATGTCATTCCCGTGCGCCGGCGGGGTGATAGCAGGGGCAGCCTGCTGTC
GCCCCGGCCCATTTCCTACTTGAAAGGCTCCTCGGGGGGTCCGCTGTTGTGCCCCGCGGG
GCACGCCGTGGGCATATTTAGGGCCGCGGTGTGCACCCGTGGAGTGGCTAAGGCGGTGGA-3900
CTTTATCCCTGTGGAGAACCTAGAGACAACCATGAGGTCCCCGGTGTTCACGGATAACTC
CTCTCCACCAGTAGTGCCCCAGAGCTTCCAGGTGGCTCACCTCCATGCTCCCACAGGCAG
CGGCAAAAGCACCAAGGTCCCGGCTGCATATGCAGCTCAGGGCTATAAGGTGCTAGTACT
CAACCCCTCTGTTGCTGCAACACTGGGCTTTGGTGCTTACATGTCCAAGGCTCATGGGAT

T
CGATCCTAACATCAGGACCGGGGTGAGAACAATTACCACTGGCAGCCCCATCACGTACTC-4200
CACCTACGGCAAGTTCCTTGCCGACGGCGGGTGCTCGGGGGGCGCTTATGACATAATAAT
TTGTGACGAGTGCCACTCCACGGATGCCACATCCATCTTGGGCATCGGCACTGTCCTTGA
CCAAGCAGAGACTGCGGGGGCGAGACTGGTTGTGCTCGCCACCGCCACCCCTCCGGGCTC
CGTCACTGTGCCCCATCCCAACATCGAGGAGGTTGCTCTGTCCACCACCGGAGAGATCCC
TTTTTACGGCAAGGCTATCCCCCTCGAAGTAATCAAGGGGGGGAGACATCTCATCTTCTG-4500
TCATTCAAAGAAGAAGTGCGACGAACTCGCCGCAAAGCTGGTCGCATTGGGCATCAATGC
CGTGGCCTACTACCGCGGTCTTGACGTGTCCGTCATCCCGACCAGCGGCGATGTTGTCGT
                                                        A
CGTGGCAACCGATGCCCTCATGACCGGCTATACCGGCGACTTCGACTCGGTGATAGACTG
CAATACGTGTGTCACCCAGACAGTCGATTTCAGCCTTGACCCTACCTTCACCATTGAGAC
AATCACGCTCCCCCAGGATGCTGTCTCCCGCACTCAACGTCGGGGCAGGACTGGCAGGGG-4800
GAAGCCAGGCATCTACAGATTTGTGGCACCGGGGGAGCGCCCCTCCGGCATGTTCGACTC
GTCCGTCCTCTGTGAGTGCTATGACGCAGGCTGTGCTTGGTATGAGCTCACGCCCGCCGA
GACTACAGTTAGGCTACGAGCGTACATGAACACCCCGGGGCTTCCCGTGTGCCAGGACCA
TCTTGAATTTTGGGAGGGCGTCTTTACAGGCCTCACTCATATAGATGCCCACTTTCTATC
CCAGACAAAGCAGAGTGGGGAGAACCTTCCTTACCTGGTAGCGTACCAAGCCACCGTGTG-5100
CGCTAGGGCTCAAGCCCCTCCCCCATCGTGGGACCAGATGTGGAAGTGTTTGATTCGCCT
CAAGCCCACCCTCCATGGGCCAACACCCCTGCTATACAGACTGGGCGCTGTTCAGAATGA
AATCACCCTGACGCACCCAGTCACCAAATACATCATGACATGCATGTCGGCCGACCTGGA
GGTCGTCACGAGCACCTGGGTGCTCGTTGGCGGCGTCCTGGCTGCTTTGGCCGCGTATTG
CCTGTCAACAGGCTGCGTGGTCATAGTGGGCAGGGTCGTCTTGTCCGGGAAGCGGCAAT-5400
CATACCTGACAGGGAAGTCCTCTACCGAGAGTTCGATGAGATGGAAGAGTGCTCTCAGCA
CTTACCGTACATCGAGCAAGGGATGATGCTCGCCGAGCAGTTCAAGCAGAAGGCCCTCGG
CCTCCTGCAGACCGCGTCCCGTCAGGCAGAGGTTATCGCCCCTGCTGTCCAGACCAACTG
GCAAAAACTCGAGACCTTCTGGGCGAAGCATATGTGGAACTTCATCAGTGGGATACAATA
CTTGGCGGGCTTGTCAACGCTGCCTGGTAACCCCGCCATTGCTTCATTGATGGCTTTTAC-5700
AGCTGCTGTCACCAGCCCACTAACCACTAGCCAAACCCTCCTCTTCAACATATTGGGGGG
GTGGGTGGCTGCCCAGCTCGCCGCCCCCGGTGCCGCTACTGCCTTTGTGGGCGCTGGCTT
AGCTGGCGCCGCCATCGGCAGTGTTGGACTGGGGAAGGTCCTCATAGAGTCCTTGCAGG
GTATGGCGCGGGCGTGGCGGGAGCTCTTGTGGCATTCAAGATCATGAGCGGTGAGGTCCC
CTCCACGGAGGACCTGGTCAATCTACTGCCCGCCATCCTCTCGCCCGGAGCCCTCGTAGT-6000
CGGCGTGGTCTGTGCAGCAATACTGCGCCGGCACGTTGGCCCGGGCGAGGGGCAGTGCA
GTGGATGAACCGGCTGATAGCCTTCGCCTCCCGGGGGAACCATGTTTCCCCCACGCACTA
CGTGCCGGAGAGCGATGCAGCTGCCCGCGTCACTGCCATACTCAGCAGCCTCACTGTAAC
CCAGCTCCTGAGGCGACTGCACCAGTGGATAAGCTCGGAGTGTACCACTCCATGCTCCGG
```

FIG. 89C

```
TTCCTGGCTAAGGGACATCTGGGACTGGATATGCGAGGTGTTGAGCGACTTTAAGACCTG-6300
GCTAAAAGCTAAGCTCATGCCACAGCTGCCTGGGATCCCCTTTGTGTCCTGCCAGCGCGG
GTATAAGGGGGTCTGGCGAGTGGACGGCATCATGCACACTCGCTGCCACTGTGGAGCTGA
GATCACTGGACATGTCAAAAACGGGACGATGAGGATCGTCGGTCCTAGGACCTGCAGGAA
CATGTGGAGTGGGACCTTCCCCATTAATGCCTACACCACGGGCCCCTGTACCCCCCTTCC
TGCGCCGAACTACACGTTCGCGCTATGGAGGGTGTCTGCAGAGGAATATGTGGAGATAAG-6600
GCAGGTGGGGGACTTCCACTACGTGACGGGTATGACTACTGACAATCTCAAATGCCCGTG
CCAGGTCCCATCGCCCGAATTTTTCACAGAATTGGACGGGGTGCGCCTACATAGGTTTGC
GCCCCCCTGCAAGCCCTTGCTGCGGGAGGAGGTATCATTCAGAGTAGGACTCCACGAATA
CCCGGTAGGGTCGCAATTACCTTGCGAGCCCGAACCGGACGTGGCCGTGTTGACGTCCAT
GCTCACTGATCCCTCCCATATAACAGCAGAGGCGGCCGGGCGAAGGTTGGCGAGGGGATC-6900
ACCCCCCTCTGTGGCCAGCTCCTCGGCTAGCCAGCTATCCGCTCCATCTCTCAAGGCAAC
TTGCACCGCTAACCATGACTCCCCTGATGCTGAGCTCATAGAGGCCAACCTCCTATGGAG
GCAGGAGATGGGCGGCAACATCACCAGGGTTGAGTCAGAAAACAAAGTGGTGATTCTGGA
CTCCTTCGATCCGCTTGTGGCGGAGGAGGACGAGCGGGAGATCTCCGTACCCGCAGAAAT
CCTGCGGAAGTCTCGGAGATTCGCCCAGGCCCTGCCCGTTTGGGCGCGGCCGGACTATAA-7200
CCCCCCGCTAGTGGAGACGTGGAAAAAGCCCGACTACGAACCACCTGTGGTCCATGGCTG
TCCGCTTCCACCTCCAAAGTCCCCTCCTGTGCCTCCGCCTCGGAAGAAGCGGACGGTGGT
CCTCACTGAATCAACCCTATCTACTGCCTTGGCCGAGCTCGCCACCAGAAGCTTTGGCAG
CTCCTCAACTTCCGGCATTACGGGCGACAATACGACAACATCCTCTGAGCCCGCCCCTTC
TGGCTGCCCCCCCGACTCCGACGCTGAGTCCTATTCCTCCATGCCCCCCCTGGAGGGGGA-7500
GCCTGGGGATCCGGATCTTAGCGACGGGTCATGGTCAACGGTCAGTAGTGAGGCCAACGC
GGAGGATGTCGTGTGCTGCTCAATGTCTTACTCTTGGACAGGCGCACTCGTCACCCCGTG
CGCCGCGGAAGAACAGAAACTGCCCATCAATGCACTAAGCAACTCGTTGCTACGTCACCA
CAATTTGGTGTATTCCACCACCTCACGCAGTGCTTGCCAAAGGCAGAAGAAAGTCACATT
TGACAGACTGCAAGTTCTGGACAGCCATTACCAGGACGTACTCAAGGAGGTTAAAGCAGC-7800
GGCGTCAAAAGTGAAGGCTAACTTGCTATCCGTAGAGGAAGCTTGCAGCCTGACGCCCCC
ACACTCAGCCAAATCCAAGTTTGGTTATGGGGCAAAAGACGTCCGTTGCCATGCCAGAAA
GGCCGTAACCCACATCAACTCCGTGTGGAAAGACCTTCTGGAAGACAATGTAACACCAAT
AGACACTACCATCATGGCTAAGAACGAGGTTTTCTGCGTTCAGCCTGAGAAGGGGGGTCG
TAAGCCAGCTCGTCTCATCGTGTTCCCCGATCTGGGCGTGCGCGTGTGCGAAAAGATGGC-8100
TTTGTACGACGTGGTTACAAAGCTCCCCTTGGCCGTGATGGGAAGCTCCTACGGATTCCA
ATACTCACCAGGACAGCGGGTTGAATTCCTCGTGCAAGCGTGGAAGTCCAAGAAAACCCC
AATGGGGTTCTCGTATGATACCCGCTGCTTTGACTCCACAGTCACTGAGAGCGACATCCG
TACGGAGGAGGCAATCTACCAATGTTGTGACCTCGACCCCCAAGCCCGCGTGGCCATCAA
GTCCCTCACCGAGAGGCTTTATGTTGGGGGCCCTCTTACCAATTCAAGGGGGGAGAACTG-8400
CGGCTATCGCAGGTGCCGCGCGAGCGGCGTACTGACAACTAGCTGTGGTAACACCCTCAC
TTGCTACATCAAGGCCCGGGCAGCCTGTCGAGCCGCAGGGCTCCAGGACTGCACCATGCT
CGTGTGTGGCGACGACTTAGTCGTTATCTGTGAAAGCGCGGGGGTCCAGGAGGACGCGGC
GAGCCTGAGAGCCTTCACGGAGGCTATGACCAGGTACTCCGCCCCCCCTGGGGACCCCCC
ACAACCAGAATACGACTTGGAGCTCATAACATCATGCTCCTCCAACGTGTCAGTCGCCCA-8700
CGACGGCGCTGGAAAGAGGGTCTACTACCTCACCCGTGACCCTACAACCCCCCTCGCGAG
AGCTGCGTGGGAGACAGCAAGACACACTCCAGTCAATTCCTGGCTAGGCAACATAATCAT
GTTTGCCCCCACACTGTGGGCGAGGATGATACTGATGACCCATTTCTTTAGCGTCCTTAT
AGCCAGGGACCAGCTTGAACAGGCCCTCGATTGCGAGATCTACGGGGCCTGCTACTCCAT
AGAACCACTGGATCTACCTCCAATCATTCAAAGACTCCATGGCCTCAGCGCATTTTCACT-9000
CCACAGTTACTCTCCAGGTGAAATTAATAGGGTGGCCGCATGCCTCAGAAAACTTGGGGT
                          G
ACCGCCCTTGCGAGCTTGGAGACACCGGGCCCGGAGCGTCCGCGCTAGGCTTCTGGCCAG
AGGAGGCAGGGCTGCCATATGTGGCAAGTACCTCTTCAACTGGGCAGTAAGAACAAAGCT
CAAACTCACTCCAATAGCGGCCGCTGGCCAGCTGGACTTGTCCGGCTGGTTCACGGCTGG
CTACAGCGGGGGAGACATTTATCACAGCGTGTCTCATGCCCGGCCCCGCTGGATCTGGTT-9300
TTGCCTACTCCTGCTTGCTGCAGGGGTAGGCATCTACCTCCTCCCCAACCGATGAAGGTT
GGGGTAAACACTCCGGCCT-----------------------3'terminus
```

Some clonal heterogeneities producing amino acid substitutions are shown. There are many other "silent mutations (not shown).

FIG. 90A

```
         R T
MSTNPKPQKKNKRNTNRRPQDVKFPGGGQIVGGVYLLPRRGPRLGVRATR
KTSERSQPRGRRQPIPKARRPEGRTWAQPGYPWPLYGNEGCGWAGWLLSP-100
RGSRPSWGPTDPRRRSRNLGKVIDTLTCGFADLMGYIPLVGAPLGGAARA

T
LAHGVRVLEDGVNYATGNLPGCSFSIFLLALLSCLTVPASAYQVRNSTGL-200
YHVTNDCPNSSIVYEAADAILHTPGCVPCVREGNASRCWVAMTPTVATRD
GKLPATQLRRHIDLLVGSATLCSALYVGDLCGSVFLVGQLFTFSPRRHWT-300

V
TQGCNCSIYPGHITGHRMAWDMMMNWSPTTALVMAQLLRIPQAILDMIAG
AHWGVLAGIAYFSMVGNWAKVLVVLLLFAGVDAETHVTGGSAGHTVSGFV-400
SLLAPGAKQNVQLINTNGSWHLNSTALNCNDSLNTGWLAGLFYHHKFNSS
GCPERLASCRPLTDFDQGWGPISYANGSGPDQRPYCWHYPPKPCGIVPAK-500
SVCGPVYCFTPSPVVVGTTDRSGAPTYSWGENDTDVFVLNNTRPPLGNWF
GCTWMNSTGFTKVCGAPPCVIGGAGNNTLHCPTDCFRKHPDATYSRCGSG-600

I
PWLTPRCLVDYPYRLWHYPCTINYTIFKIRMYVGGVEHRLEAACNWTRGE
RCDLEDRDRSELSPLLLTTTQWQVLPCSFTTLPALSTGLIHLHQNIVDVQ-700
YLYGVGSSIASWAIKWEYVVLLFLLLADARVCSCLWMMLLISQAEAALEN
LVILNAASLAGTHGLVSFLVFFCFAWYLKGKWVPGAVYTFYGMWPLLLLL-800

(N)
LALPQRAYALDTEVAASCGGVVLVGLMALTLSPYYKRYISWCLWWLQYFL
TRVEAQLHVWIPPLNVRGGRDAVILLMCAVHPTLVFDITKLLLAVFGPLW-900
ILQASLLKVPYFVRVQGLLRFCALARKMIGGHYVQMVIIKLGALTGTYVY
NHLTPLRDWAHNGLRDLAVAVEPVVFSQMETKLITWGADTAACGDIINGL-1000
PVSARRGREILLGPADGMVSKGWRLLAPITAYAQQTRGLLGCIITSLTGR
DKNQVEGEVQIVSTAAQTFLATCINGVCWTVYHGAGTRTIASPKGPVIQM-1100

S T
YTNVDQDLVGWPAPQGSRSLTPCTCGSSDLYLVTRHADVIPVRRRGDSRG
SLLSPRPISYLKGSSGGPLLCPAGHAVGIFRAAVCTRGVAKAVDFIPVEN-1200
LETTMRSPVFTDNSSPPVVPQSFQVAHLHAPTGSGKSTKVPAAYAAQGYK

L
VLVLNPSVAATLGFGAYMSKAHGIDPNIRTGVRTITTGSPITYSTYGKFL-1300
ADGGCSGGAYDIIICDECHSTDATSILGIGTVLDQAETAGARLVVLATAT
PPGSVTVPHPNIEEVALSTTGEIPFYGKAIPLEVIKGGRHLIFCHSKKKC-1400
DELAAKLVALGINAVAYYRGLDVSVIPTSGDVVVVATDALMTGYTGDFDS

Y              (S)
VIDCNTCVTQTVDFSLDPTFTIETITLPQDAVSRTQRRGRTGRGKPGIYR-1500
FVAPGERPSGMFDSSVLCECYDAGCAWYELTPAETTVRLRAYMNTPGLPV
CQDHLEFWEGVFTGLTHIDAHFLSQTKQSGENLPYLVAYQATVCARAQAP-1600
PPSWDQMWKCLIRLKPTLHGPTPLLYRLGAVQNEITLTHPVTKYIMTCMS
ADLEVVTSTWVLVGGVLAALAAYCLSTGCVVIVGRVVLSGKPAIIPDREV-1700
LYREFDEMEECSQHLPYIEQGMMLAEQFKQKALGLLQTASRQAEVIAPAV
QTNWQKLETFWAKHMWNFISGIQYLAGLSTLPGNPAIASLMAFTAAVTSP-1800
LTTSQTLLFNILGGWVAAQLAAPGAATAFVGAGLAGAAIGSVGLGKVLID
```

FIG. 90B

```
                                  (G)
ILAGYGAGVAGALVAFKIMSGEVPSTEDLVNLLPAILSPGALVVGVVCAA-1900

(HC)
ILRRHVGPGEGAVQWMNRLIAFASRGNHVSPTHYVPESDAAARVTAILSS
LTVTQLLRRLHQWISSECTTPCSGSWLRDIWDWICEVLSDFKTWLKAKLM-2000

(V)
PQLPGIPFVSCQRGYKGVWRGDGIMHTRCHCGAEITGHVKNGTMRIVGPR
TCRNMWSGTFPINAYTTGPCTPLPAPNYTFALWRVSAEEYVEIRQVGDFH-2100
YVTGMTTDNLKCPCQVPSPEFFTELDGVRLHRFAPPCKPLLREEVSFRVG
LHEYPVGSQLPCEPEPDVAVLTSMLTDPSHITAEAAGRRLARGSPPSVAS-2200
SSASQLSAPSLKATCTANHDSPDAELIEANLLWRQEMGGNITRVESENKV
VILDSFDPLVAEEDEREISVPAEILRKSRRFAQALPVWARPDYNPPLVET-2300

(S)
WKKPDYEPPVVHGCPLPPPKSPPVPPPRKKRTVVLTESTLSTALAELATR (FA)
SFGSSSTSGITGDNTTTSSEPAPSGCPPDSDAESYSSMPPLEGEPGDPDL-2400
SDGSWSTVSSEANAEDVVCCSMSYSWTGALVTPCAAEEQKLPINALSNSL
LRHHNLVYSTTSRSACQRQKKVTFDRLQVLDSHYQDVLKEVKAAASKVKA-2500

(F)
NLLSVEEACSLTPPHSAKSKFGYGAKDVRCHARKAVTHINSVWKDLLEDN
VTPIDTTIMAKNEVFCVQPEKGGRKPARLIVFPDLGVRVCEKMALYDVVT-2600
KLPLAVMGSSYGFQYSPGQRVEFLVQAWKSKKTPMGFSYDTRCFDSTVTE (G)
SDIRTEEAIYQCCDLDPQARVAIKSLTERLYVGGPLTNSRGENCGYRRCR-2700
ASGVLTTSCGNTLTCYIKARAACRAAGLQDCTMLVCGDDLVVICESAGVQ
EDAASLRAFTEAMTRYSAPPGDPPQPEYDLELITSCSSNVSVAHDGAGKR-2800
VYYLTRDPTTPLARAAWETARHTFVNSWLGNIIMFAPTLWARMILMTHFF
SVLIARDQLEQALDCEIYGACYSIEPLDLPPIIQRLHGLSAFSLHSYSPG-2900

G
EINRVAACLRKLGVPPLRAWRHRARSVRARLLARGGRAAICGKYLFNWAV (P)
RTKLKLTPIAAAGQLDLSGWFTAGYSGGDIYHSVSHARPRWIWFCLLLLA-3000
AGVGIYLLPNRO-3011
```

Stop codon ( ) = Heterogeneity due possibly
to 5' or 3' terminal cloning
artefact.

NANBV DIAGNOSTICS AND VACCINES

This application is a continuation of application Ser. No. 07/722,489, filed Jun. 24, 1991.

TECHNICAL FIELD

The invention relates to materials and methodologies for managing the spread of non-A, non-B hepatitis virus (NANBV) infection. More specifically, it relates to diagnostic DNA fragments, diagnostic proteins, diagnostic antibodies and protective antigens and antibodies for an etiologic agent of NANB hepatitis, i.e., hepatitis C virus.

REFERENCES CITED IN THE APPLICATION

Barr et al., *Biotechniques* (1986) 4:428.
Bradley et al., *Gastroenterology* (1985) 88:773.
Botstein, *Gene* (1979) 8:17.
M. A. Brinton, (1986) in "The Viruses: The Togaviridae and Flaviviridae" (Series eds. Fraenkel-Conrat and Wagner, vol. eds. Schlesinger and Schlesinger, Plenum Press), p.327–374.
Broach (1981) in: "Molecular Biology of the Yeast—Saccharomyces, Vol. 1, p.445, Cold Spring Harbor Press.
Broach et al., *Meth Enzymol* (1983) 101:307.
Catty (1988), "Antibodies, Volume 1: A Practical Approach" (IRL Press).
Chaney et al., *Cell Mol Genet* (1986) 12:237.
Chakrabarti et al., *Mol Cell Biol* (1985) 5:3403.
Chang et al., *Nature* (1977) 198:1056.
Chen and Seeburg, *DNA* (1985) 4:165.
Chirgwin et al., *Biochemistry* (1979) 18:5294.
Chomczynski and Sacchi, *Anal Biochem* (1987) 162:156.
Choo et al., Science (1989) 244:359.
Clewell et al., *Proc Natl Acad Sci USA* (1969) 62:1159.
Clewell, *J Bacteriol* (1972) 110:667.
Cohen, *Proc Natl Acad Sci USA* (1972) 69:2110.
Cousens et al., *Gene* (1987) 61:265.
De Boer et al., *Proc Natl Acad Sci USA* (1983) 292:128.
Dreesman et al., *J Infect Dis* (1985) 151:761.
S. M. Feinstone and J. H. Hoofnagle, *New Engl J Med* (1984) 311:185.
Felgner et al., *Proc Natl Acad Sci USA* (1987) 84:7413.
Fields & Knipe (1986), "Fundamental Virology" (Raven Press, N.Y.).
Fiers et al., *Nature* (1978) 273:113.
R. J. Gerety et al., in "Viral Hepatitis and Liver Disease" (B. N. Vyas, J. L. Dienstag, and J. H. Hoofnagle, eds)
Glennie et al., *Nature* (1982) 295:712.
Gluzman, *Cell* (1981) 23:175.
Goeddel et al., *Nuc Acids Res* (1980) 8:4057.
Graham and Van der Eb, *Virology* (1978) 52:546.
Grunstein and Hogness, *Proc Natl Acad Sci USA* (1975) 73:3961.
Grych et al., *Nature* (1985) 316:74.
Gubler and Hoffman *Gene* (1983) 25:263.
Hahn, *Virology* (1988) 162:167.
Hammerling et al., (1981), "Monoclonal Antibodies and T-Cell Hybridomas".
Han, *Biochemistry* (1987) 26:1617.
Helfman, *Proc Natl Acad Sci USA* (1983) 80:31.
Hess et al., *J Adv Enzyme Reg* (1968) 7:149.
Hinnen et al., *Proc Natl Acad Sci USA* (1978) 75:1929.
Hitzeman et al., *J Biol Chem* (1980)255:2073.
Holland et al., *Biochemistry* (1978) 17:4900.
Holland, *J Biol Chem* (1981) 256:1385.
Holland and Holland, *J Biol Chem* (1980) 255:2596.
Hoopes et al., *Nuc Acids Res* (1981) 9:5493.
Houghton et al., *Nuc Acids Res* (1981) 9:247
T. V. Hunyh et al., (1985) in "DNA Cloning Techniques; A Practical Approach" (D. Glover, Ed., IRL Press, Oxford, U.K.) pp. 49–78.
*Immun Rev* (1982) 62:185.
Ito et al., *Agric Biol Chem* (1984) 48:341.
Iwarson, *British Medical J* (1987) 295:946.
Kennett et al. (1980) "Monoclonal Antibodies".
Kniskern et al., *Gene* (1986) 46:135.
Kyte and Doolittle, *J Mol Bio* (1982) 157:105–132.
Laemmli, *Nature* (1970) 227:680.
Lee et al., *Science* (1988) 239:1288.
Luckow and Summers, *Virol* (1989) 17:31.
Mackett et al., *J Virol* (1984) 49:857.
T. Maniatis et al. (1982) "Molecular Cloning; A Laboratory Manual" (Cold Spring Harbor Press, Cold Spring Harbor, N.Y.).
Sambrook et al. (1989), "Molecular Cloning; A Laboratory Manual", Second Edition (Cold Spring Harbor Press, Cold Spring Harbor, N.Y.).
Manning and Mocarski, *Virol* (1988) 167:477.
Mayer and Walker, eds. (1987), "Immunochemical Methods In Cell And Molecular Biology" (Academic Press, London).
Maxam et al., *Meth Enzymol* (1980) 65:499.
MacNamara et al., *Science* (1984) 226:1325.
Messing et al., *Nuc Acids Res* (1981) 9:309.
Messing, *Meth Enzymol* (1983) 101:20–37.
Michelle et al., Int. Symposium on Viral Hepatitis.
Monath (1986) in "The Viruses: The Togaviradae And Flaviviridae" (Series eds. Fraenkel Conrat and Wagner, vol. eds. Schlesinger and Schlesinger, Plenum Press), pp. 375–440.
Moss (1987) in "Gene Transfer Vectors For Mammalian Cells" (Miller and Calos, eds., Cold Spring Harbor Laboratory, Cold Spring Harbor, N.Y.), p. 10.
Nagahuma et al., *Anal Biochem* (1984) 141:74.
Neurath et al., *Science* (1984) 224:392.
Nisonoff et al., *Clin Immunol Immunopathol* (1981) 21:397–406.
L. R. Overby, *Curr Hepatol* (1985) 5:49.
L. R. Overby, *Curr Hepatol* (1986) 6:65.
L. R. Overby, *Curr Hepatol* (1987) 7:35.
Pachl et al., *J Virol* (1987) 61:315.
Peleg, *Nature* (1969) 221:193.
Pfefferkorn and Shapiro (1974), in "Comprehensive Virology", Vol. 2 (Fraenkel-Conrat & Wagner, eds., Plenum, N.Y.) pp. 171–230.
A. M. Prince, *Ann Rev Microbiol* (1983) 37:217.
Rice et al., *Science* (1985) 229:726.
Rice et al. (1986) in "The Viruses: The Togaviridae And Flaviviridae" (Series eds. Fraenkel-Conrat and Wagner, vol. eds. Schlesinger and Schlesinger, Plenum Press), p.279–328. Roehrig (1986) in "The Viruses: The Togaviridae And Flaviviridae" (Series eds. Fraenkel-Conrat and Wagner, vol. eds. Schlesinger and Schlesinger, Plenum Press)
Sadler et al., Gene (1980) 8:279.
Saiki et al., *Nature* (1986) 324:163.
Saiki et al., *Science* (1988) 239:487.
Sanger et al., *Proc Natl Acad Sci USA* (1977) 74:5463.
Setlow, ed. (1988), "Genetic Engineering" Vol. 10, pp. 195–219 (Plenum Publishing Co., N.Y.
Schlesinger et al., *J Virol* (1986) 60:1153.
M. Schreier et al., (1980) "Hybridoma Techniques"
Scopes (1984), "Protein Purification, Principles and Practice", 2nd Ed., (Springer-Verlag, N.Y.).

Shimatake et al., *Nature* (1981) 292:128.
Singh et al., *Nuc Acids Res* (1983) 11:4049.
Sippel, *Eur J Biochem* (1973) 37:31.
Smith et al., *Mol Cell Biol* (1983) 3:2156–2165.
Steimer et al., *J Virol* (1986) 58:9.
Stollar (1980), in "The Togaviruses" (R. W. Schlesinger, ed., Academic Press, N.Y.), pp. 584–622.
Stuve et al., *J Virol* (1987) 61:326.
Sumiyoshi et al., *Virol* (1987) 161:497.
Taylor et al., *Biochim Biophys Acta* (1976) 442:324.
Towbin et al., *Proc Natl Acad Sci USA* (1979) 76:4350.
Tsu and Herzenberg (1980), in "Selected Methods In Cellular Immunology" (W. H. Freeman and Co.) pp. 373–391.
Vytdehaag et al., *J Immunol* (1985) 134:1225.
P. Valenzuela et al., *Nature* (1982) 298:344.
P. Valenzuela et al., (1984), in "Hepatitis B" (I. Millman et al., ed, Plenum Press) pp. 225–236.
Warner, *DNA* (1984) 3:401.
Ward et al., *Nature* (1989) 341:544.
Wu and Grossman, *Meth Enzymol* (1987), 154 "Recombinant DNA", Part E.
Wu, *Meth Enzymol* (1987), 155, "Recombinant DNA", part F.
Zoller, *Nuc Acids Res* (1982) 10:6487.

CITED PATENTS

U.S. Pat. No. 4,341,761
U.S. Pat. No. 4,399,121
U.S. Pat. No. 4,427,783
U.S. Pat. No. 4,444,887
U.S. Pat. No. 4,466,917
U.S. Pat. No. 4,472,500
U.S. Pat. No. 4,491,632
U.S. Pat. No. 4,493,890
U.S. Pat. No. 4,816,467

BACKGROUND ART

Non-A, Non-B hepatitis (NANBH) is a transmissible disease or family of diseases that are believed to be viral-induced, and that are distinguishable from other forms of viral-associated liver diseases, including that caused by the known hepatitis viruses, i.e., hepatitis A virus (HAV), hepatitis B virus (HBV), and delta hepatitis virus (HDV), as well as the hepatitis induced by cytomegalovirus (CMV) or Epstein-Barr virus (EBV). NANBH was first identified in transfused individuals. Transmission from man to chimpanzee and serial passage in chimpanzees provided evidence that NANBH is due to a transmissible infectious agent or agents. However, the transmissible agent responsible for NANBH is still unidentified and the number of agents which are causative of the disease are unknown.

Epidemiologic evidence is suggestive that there may be three types of NANBH: the water-borne epidemic type; the blood or needle associated type; and the sporadically occurring (community acquired) type. However, the number of agents which may be the causative of NANBH are unknown.

Clinical diagnosis and identification of NANBH has been accomplished primarily by exclusion of other viral markers. Among the methods used to detect putative NANBV antigens and antibodies are agar-gel diffusion, counterimmunoelectrophoresis, immunofluorescence microscopy, immune electron microscopy, radioimmunoassay, and enzyme-linked immunosorbent assay. However, none of these assays has proved to be sufficiently sensitive, specific, and reproducible to be used as a diagnostic test for NANBH.

Until now there has been neither clarity nor agreement as to the identity or specificity of the antigen antibody systems associated with agents of NANBH. This is due, at least in part, to the prior or co-infection of HBV with NANBV in individuals, and to the known complexity of the soluble and particulate antigens associated with HBV, as well as to the integration of HBV DNA into the genome of liver cells. In addition, there is the possibility that NANBH is caused by more than one infectious agent, as well as the possibility that NANBH has been misdiagnosed. Moreover, it is unclear what the serological assays detect in the serum of patients with NANBH. It has been postulated that the agar-gel diffusion and counterimmunoelectrophoresis assays detect autoimmune responses or nonspecific protein interactions that sometimes occur between serum specimens, and that they do not represent specific NANBV antigen-antibody reactions. The immunofluorescence, and enzyme-linked immunosorbent, and radioimmunoassays appear to detect low levels of a rheumatoid-factor-like material that is frequently present in the serum of patients with NANBH as well as in patients with other hepatic and non-hepatic diseases. Some of the reactivity detected may represent antibody to host-determined cytoplasmic antigens.

There are a number of alleged candidate NANBV. See, for example the reviews by Prince (1983), Feinstone and Hoofnagle (1984), and Overby (1985, 1986, 1987) and the article by Iwarson (1987). However, the field has not accepted that any of these candidates represent the etiological agent of NANBH.

The demand for sensitive, specific methods for screening and identifying carriers of NANBV and NANBV contaminated blood or blood products is significant. Post-transfusion hepatitis (PTH) occurs in approximately 10% of transfused patients, and NANBH accounts for up to 90% of these cases. The major problem in this disease is the frequent progression to chronic liver damage (25–55%).

Patient care as well as the prevention of transmission of NANBH by blood and blood products or by close personal contact require reliable diagnostic and prognostic tools to detect nucleic acids, antigens and antibodies related to NANBV. In addition, there is also a need for effective vaccines and immunotherapeutic therapeutic agents for the prevention and/or treatment of the disease.

DISCLOSURE OF THE INVENTION

The invention pertains to the isolation and characterization of a newly discovered etiologic agent of NANBH, hepatitis C virus (HCV), its nucleotide sequences, its protein sequences and resulting polynucleotides, polypeptides and antibodies derived therefrom. The inventions described herein were made possible by the discovery of cDNA replicas isolated by a technique which included a novel step of screening expression products from cDNA libraries created from a particulate agent in infected tissue with sera from patients with NANBH to detect newly synthesized antigens derived from the genome of the heretofore unisolated and uncharacterized viral agent, and of selecting clones which produced products which reacted immunologically only with sera from infected individuals as compared to non-infected individuals.

Studies of the nature of the genome of the HCV, utilizing probes derived from the HCV cDNA, as well as sequence information contained within the HCV cDNA, are suggestive that HCV is a positive-stranded RNA virus which appears to be distantly related to the flaviviridae family, and to the pestiviruses.

Portions of the cDNA sequences derived from HCV are useful as probes to diagnose the presence of virus in samples, and to isolate naturally occurring variants of the virus. These cDNAs also make available polypeptide sequences of HCV antigens encoded within the HCV genome(s) and permits the production of polypeptides which are useful as standards or reagents in diagnostic tests and/or as components of vaccines. Antibodies, including for example both polyclonal and monoclonal, directed against HCV epitopes contained within these polypeptide sequences are also useful for diagnostic tests, as therapeutic agents, for screening of antiviral agents, and for the isolation of the NANBV agent from which these cDNAs derive. In addition, by utilizing probes derived from these cDNAs it is possible to isolate and sequence other portions of the HCV genome, thus giving rise to additional probes and polypeptides which are useful in the diagnosis and/or treatment, both prophylactic and therapeutic, of NANBH.

Accordingly with respect to polynucleotides, some aspects of the invention are: a purified HCV polynucleotide; a recombinant HCV polynucleotide; a recombinant polynucleotide comprising a sequence derived from an HCV genome or from HCV cDNA; a recombinant polynucleotide encoding an epitope of HCV; a recombinant vector containing any of the above recombinant polynucleotides, and a host cell transformed with any of these vectors.

Other aspects of the invention are: a recombinant expression system comprising an open reading frame (ORF) of DNA derived from an HCV genome or from HCV cDNA, wherein the ORF is operably linked to a control sequence compatible with a desired host, a cell transformed with the recombinant expression system, and a polypeptide produced by the transformed cell.

Still other aspects of the invention are: purified HCV, a preparation of polypeptides from the purified HCV; a purified HCV polypeptide; a purified polypeptide comprising an epitope which is immunologically identifiable with an epitope contained in HCV.

Included aspects of the invention are a recombinant HCV polypeptide; a recombinant polypeptide comprised of a sequence derived from an HCV genome or from HCV cDNA; a recombinant polypeptide comprised of an HCV epitope; and a fusion polypeptide comprised of an HCV polypeptide.

Also included in the invention are a monoclonal antibody directed against an HCV epitope; and a purified preparation of polyclonal antibodies directed against an HCV epitope; and an anti-idiotype antibody comprising a region which mimics an HCV epitope.

Another aspect of the invention is a particle which is immunogenic against HCV infection comprising a non-HCV polypeptide having an amino acid sequence capable of forming a particle when said sequence is produced in a eukaryotic host, and an HCV epitope.

Still another aspect of the invention is a polynucleotide probe for HCV.

Aspects of the invention which pertain to kits are those for: analyzing samples for the presence of polynucleotides derived from HCV comprising a polynucleotide probe containing a nucleotide sequence from HCV of about 8 or more nucleotides, in a suitable container; analyzing samples for the presence of an HCV antigen comprising an antibody directed against the HCV antigen to be detected, in a suitable container; analyzing samples for the presence of an antibodies directed against an HCV antigen comprising a polypeptide containing an HCV epitope present in the HCV antigen, in a suitable container.

Other aspects of the invention are: a polypeptide comprising an HCV epitope, attached to a solid substrate; and an antibody to an HCV epitope, attached to a solid substrate.

Still other aspects of the invention are: a method for producing a polypeptide containing an HCV epitope comprising incubating host cells transformed with an expression vector containing a sequence encoding a polypeptide containing an HCV epitope under conditions which allow expression of said polypeptide; and a polypeptide containing an HCV epitope produced by this method.

The invention also includes a method for detecting HCV nucleic acids in a sample comprising reacting nucleic acids of the sample with a probe for an HCV polynucleotide under conditions which allow the formation of a polynucleotide duplex between the probe and the HCV nucleic acid from the sample; and detecting a polynucleotide duplex which contains the probe.

Still other aspects are also included in the invention. These include an immunoassay for detecting an HCV antigen comprising incubating a sample suspected of containing an HCV antigen with a probe antibody directed against the HCV antigen to be detected under conditions which allow the formation of an antigen-antibody complex; and detecting an antigen-antibody complex containing the probe antibody. An immunoassay for detecting antibodies directed against an HCV antigen comprising incubating a sample suspected of containing anti-HCV antibodies with a probe polypeptide which contains an epitope of the HCV, under conditions which allow the formation of an antibody-antigen complex; and detecting the antibody-antigen complex containing the probe antigen.

Also included in the invention are vaccines for treatment of HCV infection comprising an immunogenic peptide containing an HCV epitope, or an inactivated preparation of HCV, or an attenuated preparation of HCV.

Another aspect of the invention is a tissue culture grown cell infected with HCV.

Yet another aspect of the invention is a method for producing antibodies to HCV comprising administering to an individual an isolated immunogenic polypeptide containing an HCV epitope in an amount sufficient to produce an immune response.

BRIEF DESCRIPTION OF THE DRAWINGS

FIG. 1 (SEQ ID NO:1 and SEQ ID NO:2) shows the double-stranded nucleotide sequence of the HCV cDNA insert in clone 5-1-1, and the putative amino acid sequence of the polypeptide encoded therein.

FIG. 2 (SEQ ID NO:3, SEQ ID NO:4, SEQ ID NO:5 and SEQ ID NO:6) shows the homologies of the overlapping HCV cDNA sequences in clones 5-1-1, 81, 1-2, and 91.

FIG. 3 (SEQ ID NO:7 and SEQ ID NO:8) shows a composite sequence of HCV cDNA derived from overlapping clones 81, 1-2, and 91, and the amino acid sequence encoded therein.

FIG. 4 (SEQ ID NO:9 and SEQ ID NO:10) shows the double-stranded nucleotide sequence of the HCV cDNA insert in clone 81, and the putative amino acid sequence of the polypeptide encoded therein.

FIG. 5 (SEQ ID NO:11 and SEQ ID NO:12) shows the HCV cDNA sequence in clone 36, the segment which overlaps the NANBV cDNA of clone 81, and the polypeptide sequence encoded within clone 36.

FIG. 6 (SEQ ID NO:13 and SEQ ID NO:14) shows the combined ORF of HCV cDNAs in clones 36 and 81, and the polypeptide encoded therein.

FIG. 7 (SEQ ID NO:15 and SEQ ID NO:16) shows the HCV cDNA sequence in clone 32, the segment which overlaps clone 81, and the polypeptide encoded therein.

FIG. 8 (SEQ ID NO:17 and SEQ ID NO:18) shows the HCV cDNA sequence in clone 35, the segment which overlaps clone 36, and the polypeptide encoded therein.

FIG. 9 (SEQ ID NO:19 and SEQ ID NO:20) shows the combined ORF of HCV cDNAs in clones 35, 36, 81, and 32, and the polypeptide encoded therein.

FIG. 10 (SEQ ID NO:21 and SEQ ID NO:22) shows the HCV cDNA sequence in clone 37b, the segment which overlaps clone 35, and the polypeptide encoded therein.

FIG. 11 (SEQ ID NO:23 and SEQ ID NO:24) shows the HCV cDNA sequence in clone 33b, the segment which overlaps clone 32, and the polypeptide encoded therein.

FIG. 12 (SEQ ID NO:25 and SEQ ID NO:26) shows the HCV cDNA sequence in clone 40b, the segment which overlaps clone 37b, and the polypeptide encoded therein.

FIG. 13 (SEQ ID NO:27 and SEQ ID NO:28) shows the HCV cDNA sequence in clone 25c, the segment which overlaps clone 33b, and the polypeptide encoded therein.

FIG. 14 (SEQ ID NO:29 and SEQ ID NO:30) shows the nucleotide sequence and polypeptide encoded therein of the ORF which extends through the HCV cDNAs in clones 40b, 37b, 35, 36, 81, 32, 33b, and 25c.

FIG. 15 (SEQ ID NO:31 and SEQ ID NO:32) shows the HCV cDNA sequence in clone 33c, the segment which overlaps clones 40b and 33c, and the amino acids encoded therein.

FIG. 16 (SEQ ID NO:33 and SEQ ID NO:34) shows the HCV cDNA sequence in clone 8h, the segment which overlaps clone 33c, and the amino acids encoded therein.

FIG. 17 (SEQ ID NO:35 and SEQ ID NO:36) shows the HCV cDNA sequence in clone 7e, the segment which overlaps clone 8h, and the amino acids encoded therein.

FIG. 18 (SEQ ID NO:37 and SEQ ID NO:38) shows the HCV cDNA sequence in clone 14c, the segment which overlaps clone 25c, and the amino acids encoded therein.

FIG. 19 (SEQ ID NO:39 and SEQ ID NO:40) shows the HCV cDNA sequence in clone 8f, the segment which overlaps clone 14c, and the amino acids encoded therein.

FIG. 20 (SEQ ID NO:41 and SEQ ID NO:42) shows the HCV cDNA sequence in clone 33f, the segment which overlaps clone 8f, and the amino acids encoded therein.

FIG. 21 (SEQ ID NO:43 and SEQ ID NO:44) shows the HCV cDNA sequence in clone 33g, the segment which overlaps clone 33f, and the amino acids encoded therein.

FIG. 22 (SEQ ID NO:45 and SEQ ID NO:46) shows the HCV cDNA sequence in clone 7f, the segment which overlaps the sequence in clone 7e, and the amino acids encoded therein.

FIG. 23 (SEQ ID NO:47 and SEQ ID NO:48) shows the HCV cDNA sequence in clone 11b, the segment which overlaps the sequence in clone 7f, and the amino acids encoded therein.

FIG. 24 (SEQ ID NO:49 and SEQ ID NO:50) shows the HCV cDNA sequence in clone 14i, the segment which overlaps the sequence in clone 11b, and the amino acids encoded therein.

FIG. 25 (SEQ ID NO:51 and SEQ ID NO:52) shows the HCV cDNA sequence in clone 39c, the segment which overlaps the sequence in clone 33g, and the amino acids encoded therein.

FIG. 26 (SEQ ID NO:53 and SEQ ID NO:54) shows a composite HCV cDNA sequence derived from the aligned cDNAs in clones 14i, 11b, 7f, 7e, 8h, 33c 40b 37b 35 36, 81, 32, 33b, 25c, 14c, 8f, 33f, and 33g; also shown is the amino acid sequence of the polypeptide encoded in the extended ORF in the derived sequence.

FIG. 27 (SEQ ID NO:55 and SEQ ID NO:56) shows the sequence of the HCV cDNA in clone 12f, the segment which overlaps clone 14i, and the amino acids encoded therein.

FIG. 28 (SEQ ID NO:57 and SEQ ID NO:58) shows the sequence of the HCV cDNA in clone 35f, the segment which overlaps clone 39c, and the amino acids encoded therein.

FIG. 29 (SEQ ID NO:59 and SEQ ID NO:60) shows the sequence of the HCV cDNA in clone 19g, the segment which overlaps clone 35f, and the amino acids encoded therein.

FIG. 30 (SEQ ID NO:61 and SEQ ID NO:62) shows the sequence of clone 26g, the segment which overlaps clone 19g, and the amino acids encoded therein.

FIG. 31 (SEQ ID NO:63 and SEQ ID NO:64) shows the sequence of clone 15e, the segment which overlaps clone 26g, and the amino acids encoded therein.

FIG. 32 (SEQ ID NO:65 and SEQ ID NO:66) shows the sequence in a composite cDNA, which was derived by aligning clones 12f through 15e in the 5' to 3' direction; it also shows the amino acids encoded in the continuous ORF.

FIG. 36 (SEQ ID NO:67 and SEQ ID NO:68) shows the putative amino acid sequence of the carboxy-terminus of the fusion polypeptide C100-3 and the nucleotide sequence encoding it.

FIG. 42 (SEQ ID NO:69 and SEQ ID NO:70) shows the homologies between a polypeptide encoded in HCV cDNA and an NS protein from Dengue flavivirus.

FIG. 45 (SEQ ID NO:71) shows the sequences in a primer mix, derived from a conserved sequence in NS1 of flaviviruses.

FIG. 46 (SEQ ID NO:72 and SEQ ID NO:73) shows the HCV cDNA sequence in clone k9-1, the segment which overlaps the cDNA in FIG. 26, and the amino acids encoded therein.

FIG. 47 (SEQ ID NO:74 and SEQ ID NO:75) shows the sequence in a composite cDNA which was derived by aligning clones k9-1 through 15e in the 5' to 3' direction; it also shows the amino acids encoded in the continuous ORF.

FIG. 48 (SEQ ID NO:76 and SEQ ID NO:77) shows the nucleotide sequence of HCV cDNA in clone 13i, the amino acids encoded therein, and the sequences which overlap with clone 12f.

FIG. 49 (SEQ ID NO:78 and SEQ ID NO:79) shows the nucleotide sequence of HCV cDNA in clone 26j, the amino acids encoded therein, and the sequences which overlap clone 13i.

FIG. 50 (SEQ ID NO:80 and SEQ ID NO:81) shows the nucleotide sequence of HCV cDNA in clone CA59a, the amino acids encoded therein, and the sequences which overlap with clones 26j and K9-1.

FIG. 51 (SEQ ID NO:82 and SEQ ID NO:83) shows the nucleotide sequence of HCV cDNA in clone CA84a, the amino acids encoded therein, and the sequences which overlap with clone CA59a.

FIG. 52 (SEQ ID NO:84 and SEQ ID NO:85) shows the nucleotide sequence of HCV cDNA in clone CA156e, the amino acids encoded therein, and the sequences which overlap with CA84a.

FIG. 53 (SEQ ID NO:86 and SEQ ID NO:87) shows the nucleotide sequence of HCV cDNA in clone CA167b, the amino acids encoded therein, and the sequences which overlap CA156e.

FIG. 54 (SEQ ID NO:88 and SEQ ID NO:89) shows the ORF of HCV cDNA derived from clones pi14a, CA167b, CA156e, CA84a, CA59a, K9-1, 12f, 14i, 11b, 7f, 7e, 8h, 33c, 40b, 37b, 35, 36, 81, 32, 33b, 25c, 14c, 8f, 33f, 33g, 39c, 35f, 19g, 26g, and 15e.

FIG. 56 (SEQ ID NO:90 and SEQ ID NO:91) shows the nucleotide sequence of HCV cDNA in clone CA216a, the amino acids encoded therein, and the overlap with clone CA167b.

FIG. 57 (SEQ ID NO:92 and SEQ ID NO:93) shows the nucleotide sequence of HCV cDNA in clone CA290a, the amino acids encoded therein, and the overlap with clone CA216a.

FIG. 58 (SEQ ID NO:94, SEQ ID NO:95, SEQ ID NO:96, SEQ ID NO:97, SEQ ID NO:98, SEQ ID NO:99, SEQ ID NO:100, SEQ ID NO:101, SEQ ID NO:102 and SEQ ID NO:103) shows the nucleotide sequence of HCV cDNA in clone ag30a and the overlap with clone CA290a.

FIG. 59 (SEQ ID NO:104, SEQ ID NO:105, SEQ ID NO:106 and SEQ ID NO:107) shows the nucleotide sequence of HCV cDNA in clone CA205a, and the overlap with the HCV cDNA sequence in clone CA290a.

FIG. 60 (SEQ ID NO:108, SEQ ID NO:109, SEQ ID NO:110, SEQ ID NO:111, SEQ ID NO:112, SEQ ID NO:113, SEQ ID NO:114, SEQ ID NO:115, SEQ ID NO:116, SEQ ID NO:117, SEQ ID NO:118 and SEQ ID NO:119) shows the nucleotide sequence of HCV cDNA in clone 18g, and the overlap with the HCV cDNA sequence in clone ag30a.

FIG. 61 (SEQ ID NO:120 and SEQ ID NO:121) shows the nucleotide sequence of HCV cDNA in clone 16jh, the amino acids encoded therein, and the overlap of nucleotides with the HCV cDNA sequence in clone 15e.

FIG. 62 (SEQ ID NO:122) shows the composite sequence of the HCV cDNA sense strand deduced from overlapping clones b114a, 18g, ag30a, CA205a, CA290a, CA216a, pi14a, CA167b, CA156e, CA84a, CA59a, K9-1 (also called k9-1), 26j, 13i, 12f, 14i, 11b, 7f, 7e, 8h, 33c, 40b, 37b, 35, 36, 81, 32, 33b, 25c, 14c, 8f, 33f, 33g, 39c, 35f, 19g, 26g, 15e, b5a, and 16jh.

FIG. 62A–C (SEQ ID NO:123) shows the sequence of FIG. 62, but includes the complementary cDNA strand.

FIG. 65 presents the antigenicity of polypeptides expressed from HCV cDNA clones used in an antigenic mapping study of the putative HCV polyprotein.

FIG. 66 (SEQ ID NO:124) presents the amino acid sequence of the putative polyprotein encoded in a composite HCV cDNA sequence shown in FIG. 62.

FIG. 68 (SEQ ID NO:125, SEQ ID NO:126, SEQ ID NO:127, SEQ ID NO:128, SEQ ID NO:129 and SEQ ID NO:130) shows the conserved co-linear peptides in HCV and Flaviviruses.

FIG. 71 (SEQ ID NO:135 and SEQ ID NO:136) shows the nucleotide sequence of clone 6k, the part of the sequence which overlaps clone 16jh, and the amino acids encoded therein.

FIG. 72 (SEQ ID NO:137 and SEQ ID NO:138) shows a composite cDNA sequence derived from overlapping clones b114a, 18g, ag30a, CA205a, CA290a, CA216a, pi14a, CA167b, CA156e, CA84a, CA59a, K9-1 (also called k9-1), 26j, 13i, 12f, 14i, 11b, 7f, 7e, 8h, 33c, 40b, 37b, 35, 36, 81, 32, 33b, 25c, 14c, 8f, 33f, 33g, 39c, 35f, 19g, 26g, 15e, b5a, 16jh and 6k; also shown are the amino acids encoded in the positive strand of the cDNA (which is the equivalent of the HCV RNA).

FIG. 73 (SEQ ID NO:139, SEQ ID NO:140, SEQ ID NO:141 and SEQ ID NO:142) shows the linkers used in the construction of $pS3-56_{C100m}$.

FIG. 74 (SEQ ID NO:143 and SEQ ID NO:144) shows the nucleotide sequence of the HCV cDNA in clone 31, the amino acids encoded therein, and putative restriction enzyme sites encoded therein.

FIG. 75 (SEQ ID NO:145 and SEQ ID NO:146) shows the nucleotide sequence of the HCV cDNA in clone p131jh, and its overlap with the nucleotide sequence in clone 6k.

FIG. 79 (SEQ ID NO:147 and SEQ ID NO:148) shows the nucleotide sequence of HCV cDNA in the C200-C100 construct, the amino acids encoded therein, and putative restriction enzyme sites encoded therein.

FIG. 80 (SEQ ID NO:149 and SEQ ID NO:150) shows the nucleotide consensus sequence of human isolate 23, variant sequences are shown below the sequence line. The amino acids encoded in the consensus sequence are also shown.

FIG. 81 (SEQ ID NO:151 and SEQ ID NO:152) shows the nucleotide consensus sequence of human isolate 27, variant sequences are shown below the sequence line. The amino acids encoded in the consensus sequence are also shown.

FIG. 82 (SEQ ID NO:153, SEQ ID NO:154 and SEQ ID NO:155) shows the aligned nucleotide sequences of human isolates 23 and 27 and of HCV1. Homologous sequences are indicated by the symbol (*). Non-homologous sequences are in small letters.

FIG. 83 (SEQ ID NO:156, SEQ ID NO:157 and SEQ ID NO:158) shows the aligned amino acid sequences of human isolates 23 and 27 and of HCV1. Homologous sequences are indicated by the symbol (*). Non-homologous sequences are in small letters.

FIG. 85 (SEQ ID NO:159, SEQ ID NO:160, SEQ ID NO:161 and SEQ ID NO:162) shows a comparison of the composite aligned nucleotide sequences of isolates Thorn, EC1, HCT #18, and HCV1.

FIG. 86 (SEQ ID NO:163 and SEQ ID NO:164) shows a comparison of the nucleotide sequences of EC10 and a composite of the HCV1 sequence; the EC10 sequence is on the line above the dots, and the HCV1 sequence is on the line below the dots.

FIG. 87 (SEQ ID NO:165, SEQ ID NO:166, SEQ ID NO:167, SEQ ID NO:168, SEQ ID NO:169 and SEQ ID NO:170) shows a comparison of the amino acid sequences 117–308 (relative to HCV1) encoded in the "EnvL" regions of the consensus sequences of human isolates HCT #18, JH23, JH 27, Thorne, EC1, and of HCV1.

FIG. 88 (SEQ ID NO:171, SEQ ID NO:172, SEQ ID NO:173, SEQ ID NO:174 and SEQ ID NO:175) shows a comparison of the amino acid sequences 330–360 (relative to HCV1) encoded in the "EnvR" regions of the consensus sequences of human isolates HCT #18, JH23, JH 27, Thorne, EC1, and of HCV1.

FIG. 89 (SEQ ID NO:176) shows a composite cDNA sequence for HCV1, deduced from overlapping clones b114a, 18g, ag30a, CA205a, CA290a, CA216a, pi14a, CA167b, CA156e, CA84a, CA59a, K9-1 (also called k9-1), 26j, 13i, 12f, 14i, 11b, 7f, 7e, 8h, 33c, 40b, 37b, 35, 36, 81, 32, 33b, 25c, 14c, 8f, 33f, 33g, 39c, 35f, 19g, 26g, 15e, b5a, 16jh, 6k, and 131jh.

FIG. 90 (SEQ ID NO:177) shows a putative polyprotein encoded in the HCV cDNA shown in FIG. 89.

MODES FOR CARRYING OUT THE INVENTION

I. Definitions

Figure 33A:
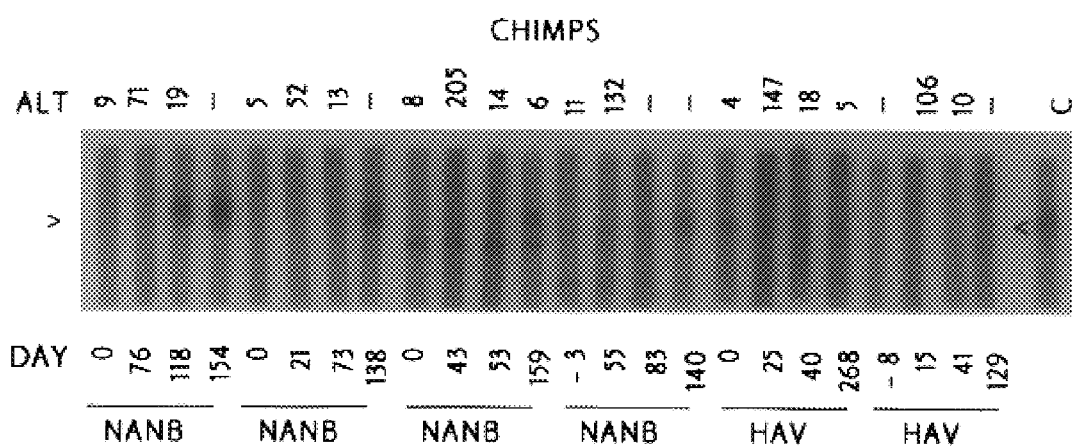
FIG. 33 shows a photograph of Western blots of a fusion protein, SOD-NANB$_{5-1-1}$, with chimpanzee serum from chimpanzees infected with BB-NANB, HAV, and HBV.

The term "hepatitis C virus" has been reserved by workers in the field for an heretofore unknown etiologic agent of NANBH. Accordingly, as used herein, "hepatitis C virus" (HCV) refers to an agent causative of NANBH, which was formerly referred to as NANBV and/or BB-NANBV. The terms HCV, NANBV, and BB-NANBV are used interchangeably herein. As an extension of this terminology, the disease caused by HCV, formerly called NANB hepatitis (NANBH), is called hepatitis C. The terms NANBH and hepatitis C may be used interchangeably herein.

HCV is a viral species of which pathogenic strains cause NANBH, and attenuated strains or defective interfering particles derived therefrom. As shown infra, the HCV genome is comprised of RNA. It is known that RNA containing viruses have relatively high rates of spontaneous mutation, i.e., reportedly on the order of $10^{-3}$ to $10^{-4}$ per incorporated nucleotide (Fields & Knipe (1986)). Therefore, since heterogeneity and fluidity of genotype are inherent in RNA viruses, there are multiple strains/isolates, which may be virulent or avirulent, within the HCV species. The compositions and methods described herein, enable the propagation, identification, detection, and isolation of the various HCV strains or isolates. Moreover, the disclosure herein allows the preparation of diagnostics and vaccines for the various strains/isolates, as well as compositions and methods that have utility in screening procedures for anti-viral agents for pharmacologic use, such as agents that inhibit replication of HCV.

Information on several different strains/isolates of HCV is disclosed herein, particularly strain or isolate CDC/HCV1 (also called HCV1). Information from one strain or isolate, such as a partial genomic sequence, is sufficient to allow those skilled in the art using standard techniques to isolate new strains/isolates and to identify whether such new strains/isolates are HCV. For example, several different strains/isolates are described in Section IV.H.7., infra. These strains, which were obtained from a number of human sera (and from different geographical areas), were isolated utilizing the information from the genomic sequence of HCV1.

The information provided herein is indicative that HCV may be distantly related to the flaviviridae. The Flavivirus family contains a large number of viruses which are small, enveloped pathogens of man. The morphology and composition of Flavivirus particles are known, and are discussed in Brinton (1986). Generally, with respect to morphology, Flaviviruses contain a central nucleocapsid surrounded by a lipid bilayer. Virions are spherical and have a diameter of about 40–50 nm. Their cores are about 25–30 nm in diameter. Along the outer surface of the virion envelope are projections that are about 5–10 nm long with terminal knobs about 2 nm in diameter. Typical examples of the family include Yellow Fever virus, West Nile virus, and Dengue Fever virus. They possess positive-stranded RNA genomes (~11,000 nucleotides) that are slightly larger than that of HCV and encode a polyprotein precursor of about 3500 amino acids. Individual viral proteins are cleaved from this precursor polypeptide.

Using the techniques derived infra, the genomic structure and the nucleotide sequence of HCV1 genomic RNA has been deduced. The genome appears to be single-stranded RNA containing ~10,000 nucleotides. The genome is positive-stranded, and possesses a continuous, translational open reading frame (ORF) that encodes a polyprotein of about 3,000 amino acids. In the ORF, the structural protein (s) appear to be encoded in approximately the first quarter of the N-terminus region, with the majority of the polyprotein responsible for nonstructural proteins. When compared with all known viral sequences, small but significant co-linear homologies are observed with the non-structural proteins of the flavivirus family, and with the pestiviruses (which are now also considered to be part of the Flavivirus family).

Figure 69:
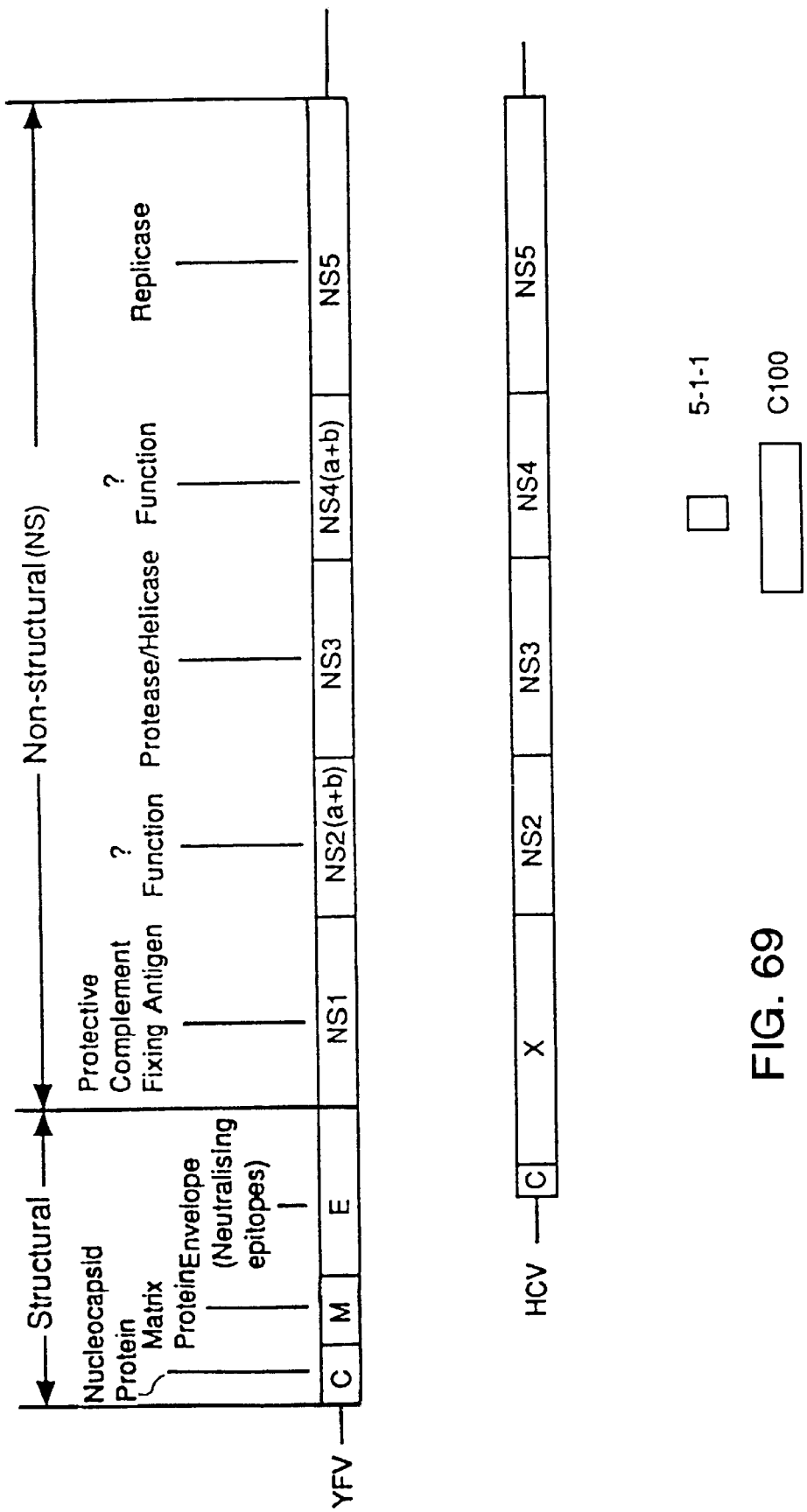
FIG. 69 shows schematic alignment of a flaviviral polyprotein and a putative HCV polyprotein encoded in the major ORF of the HCV genome. Also indicated in the figure are the possible functions of the flaviviral polypeptides cleaved from the flaviviral polyprotein. In addition, the relative placements of the HCV polypeptides, $NANB_{5-1-1}$ and C100, with respect to the putative HCV polyprotein are indicated.
Figure 70:
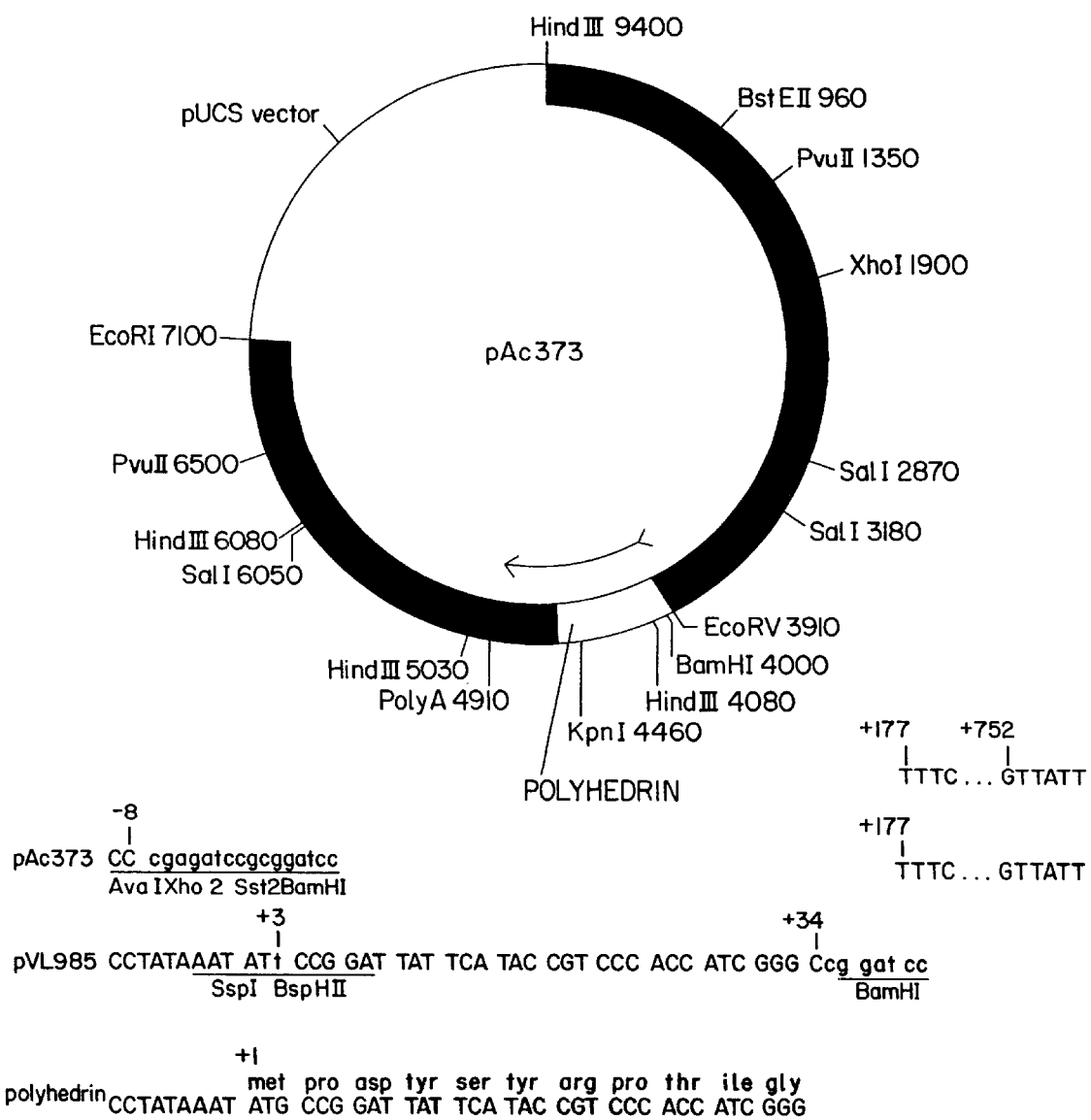
FIG. 70 (SEQ ID NO:131, SEQ ID NO:132, SEQ ID NO:133 and SEQ ID NO:134) shows relevant characteristics of AcNPV transfer vectors used for high level expression of nonfused foreign proteins. It also shows a restriction endonuclease map of the transfer vector pAc373.

A schematic alignment of possible regions of a flaviviral polyprotein (using Yellow Fever Virus as an example), and of a putative polyprotein encoded in the major ORF of the HCV genome, is shown in Fig. FIG. 69. In the figure the possible domains of the HCV polyprotein are indicated. The flavivirus polyprotein contains, from the amino terminus to the carboxy terminus, the nucleocapsid protein (C), the matrix protein (M), the envelope protein (E), and the non-structural proteins 1, 2 (a+b), 3, 4 (a+b), and 5 (NS1, NS2, NS3, NS4, and NS5). Based upon the putative amino acids encoded in the nucleotide sequence of HCV1, a small domain at the extreme N-terminus of the HCV polyprotein appears similar both in size and high content of basic residues to the nucleocapsid protein (C) found at the N-terminus of flaviviral polyproteins. The nonstructural proteins 2,3,4, and 5 (NS2-5) of HCV and of yellow fever virus (YFV) appear to have counter parts of similar size and hydropathicity, although there is divergence of the amino acid sequences. However, the region of HCV which would correspond to the regions of YFV polyprotein which contains the M, E, and NS1 protein not only differs in sequence, but also appears to be quite different both in size and hydropathicity. Thus, while certain domains of the HCV genome may be referred to herein as, for example, NS1, or NS2, it should be borne in mind that these designations are speculative; there may be considerable differences between the HCV family and flaviviruses that have yet to be appreciated.

Based upon the nucleotide sequences encoding the polypeptides $NANB_{5-1-1}$ and HCV C100, and the sequence of the ORF, the relative placements of the 5-1-1 polypeptide and the C100 polypeptide with respect to the putative HCV polyprotein have been calculated. These are also shown in FIG. 69.

Different strains, isolates or subtypes of HCV are expected to contain variations at the amino acid and nucleic acids compared with HCV1. Many isolates are expected to show much (i.e., more than about 40%) homology in the total amino acid sequence compared with HCV1. However, it may also be found that there are other less homologous HCV isolates. These would be defined as HCV according to various criteria such as, for example, an ORF of approximately 9,000 nucleotides to approximately 12,000 nucleotides, encoding a polyprotein similar in size to that of HCV1, an encoded polyprotein of similar hydrophobic and/or antigenic character to that of HCV1, and the presence of co-linear peptide sequences that are conserved with HCV1. In addition, the genome would be a positive-stranded RNA.

HCV encodes at least one epitope which is immunologically identifiable with an epitope in the HCV genome from which the cDNAs described herein are derived; preferably the epitope is contained in an amino acid sequence described herein. The epitope is unique to HCV when compared to previously known Flaviviruses. The uniqueness of the epitope may be determined by its immunological reactivity with anti-HCV antibodies and lack of immunological reactivity with antibodies to known Flavivirus species. Methods for determining immunological reactivity are known in the art, for example, by radioimmunoassay, by ELISA assay, by hemagglutination, and several examples of suitable techniques for assays are provided herein.

In addition to the above, the following parameters of nucleic acid homology and amino acid homology are applicable, either alone or in combination, in identifying a strain/isolate as HCV. Since HCV strains and isolates are evolutionarily related, it is expected that the overall homology of the genomes at the nucleotide level may be about 10% or greater, probably will be about 40% or greater, probably about 60% or greater, and even more probably about 80% or greater; and in addition that there will be corresponding contiguous sequences of at least about 13 nucleotides. It should be noted, as shown infra, that there are variable and hypervariable regions within the HCV genome; therefore, the homology in these regions is expected to be significantly less than that in the overall genome. The correspondence between the putative HCV strain genomic sequence and, for example, the CDC/HCV1 cDNA sequence can be determined by techniques known in the art. For example, they can be determined by a direct comparison of the sequence information of the polynucleotide from the putative HCV, and the HCV cDNA sequence(s) described herein. For example, also, they can be determined by hybridization of the polynucleotides under conditions which form stable duplexes between homologous regions (for example, those which would be used prior to $S_1$ digestion), followed by digestion with single stranded specific nuclease(s), followed by size determination of the digested fragments.

Because of the evolutionary relationship of the strains or isolates of HCV, putative HCV strains or isolates are identifiable by their homology at the polypeptide level. Generally, HCV strains or isolates are expected to be at least 10% homologous, more than about 40% homologous, probably more than about 70% homologous, and even more probably more than about 80% homologous, and some may even be more than about 90% homologous at the polypeptide level. The techniques for determining amino acid sequence homology are known in the art. For example, the amino acid sequence may be determined directly and compared to the sequences provided herein. Alternatively the nucleotide sequence of the genomic material of the putative HCV may be determined (usually via a cDNA intermediate), the amino acid sequence encoded therein can be determined, and the corresponding regions compared.

As used herein, a polynucleotide "derived from" a designated sequence refers to a polynucleotide sequence which is comprised of a sequence of approximately at least about 6 nucleotides, preferably at least about 8 nucleotides, more preferably at least about 10–12 nucleotides, and even more preferably at least about 15–20 nucleotides corresponding to a region of the designated nucleotide sequence. "Corresponding" means homologous to or complementary to the designated sequence. Preferably, the sequence of the region from which the polynucleotide is derived is homologous to or complementary to a sequence which is unique to an HCV genome. Whether or not a sequence is unique to the HCV genome can be determined by techniques known to those of skill in the art. For example, the sequence can be compared to sequences in databanks, e.g., Genebank, to determine whether it is present in the uninfected host or other organisms. The sequence can also be compared to the known sequences of other viral agents, including those which are known to induce hepatitis, e.g., HAV, HBV, and HDV, and to members of the Flaviviridae. The correspondence or non-correspondence of the derived sequence to other sequences can also be determined by hybridization under the appropriate stringency conditions. Hybridization techniques for determining the complementarity of nucleic acid sequences are known in the art, and are discussed infra. See also, for example, Maniatis et al. (1982). In addition, mismatches of duplex polynucleotides formed by hybridization can be determined by known techniques, including for example, digestion with a nuclease such as S1 that specifically digests single-stranded areas in duplex polynucleotides. Regions from which typical DNA sequences may be "derived" include but are not limited to, for example, regions encoding specific epitopes, as well as non-transcribed and/or non-translated regions.

The derived polynucleotide is not necessarily physically derived from the nucleotide sequence shown, but may be generated in any manner, including for example, chemical synthesis or DNA replication or reverse transcription or transcription. In addition, combinations of regions corresponding to that of the designated sequence may be modified in ways known in the art to be formulated with an intended use.

Similarly, a polypeptide or amino acid sequence "derived from" a designated nucleic acid sequence refers to a polypeptide having an amino acid sequence identical to that of a polypeptide encoded in the sequence, or a portion thereof wherein the portion consists of at least 3–5 amino acids, and more preferably at least 8–10 amino acids, and even more preferably at least 11–15 amino acids, or which is immunologically identifiable with a polypeptide encoded in the sequence. This terminology also includes a polypeptide expressed from a designated nucleic acid sequence.

A recombinant or derived polypeptide is not necessarily translated from a designated nucleic acid sequence, for example, the sequences in Section IV.A, or from an HCV genome; it may be generated in any manner, including for example, chemical synthesis, or expression of a recombinant expression system, or isolation from HCV, including mutated HCV. A recombinant or derived polypeptide may include one or more analogs of amino acids or unnatural amino acids in its sequence. Methods of inserting analogs of amino acids into a sequence are known in the art. It also may include one or more labels, which are known to those of skill in the art.

The term "recombinant polynucleotide" as used herein intends a polynucleotide of genomic, cDNA, semisynthetic, or synthetic origin which, by virtue of its origin or manipulation: (1) is not associated with all or a portion of a polynucleotide with which it is associated in nature, (2) is linked to a polynucleotide other than that to which it is linked in nature, or (3) does not occur in nature.

The term "polynucleotide" as used herein refers to a polymeric form of nucleotides of any length, either ribonucleotides or deoxyribonucleotides. This term refers only to the primary structure of the molecule. Thus, this term includes double- and single-stranded DNA and RNA. It also includes known types of modifications, for example, labels which are known in the art, methylation, "caps", substitution of one or more of the naturally occurring nucleotides with an analog, internucleotide modifications such as, for example, those with uncharged linkages (e.g., methyl phosphonates, phosphotriesters, phosphoramidates, carbamates, etc.) and with charged linkages (e.g., phosphorothioates, phosphorodithioates, etc.), those containing pendant moieties, such as, for example proteins (including for e.g., nucleases, toxins, antibodies, signal peptides, poly-L-lysine, etc.), those with intercalators (e.g., acridine, psoralen, etc.), those containing chelators (e.g., metals, radioactive metals, boron, oxidative metals, etc.), those containing alkylators, those with modified linkages (e.g., alpha anomeric nucleic acids, etc.), as well as unmodified forms of the polynucleotide.

The term "purified viral polynucleotide" refers to an HCV genome or fragment thereof which is essentially free, i.e., contains less than about 50%, preferably less than about 70%, and even more preferably less than about 90% of polypeptides with which the viral polynucleotide is naturally associated. Techniques for purifying viral polynucleotides from viral particles are known in the art, and include for example, disruption of the particle with a chaotropic agent, differential extraction and separation of the polynucleotide (s) and polypeptides by ion-exchange chromatography, affinity chromatography, and sedimentation according to density.

The term "purified viral polypeptide" refers to an HCV polypeptide or fragment thereof which is essentially free, i.e., contains less than about 50%, preferably less than about 70%, and even more preferably less than about 90%, of cellular components with which the viral polypeptide is naturally associated. Techniques for purifying viral polypeptides are known in the art, and examples of these techniques are discussed infra.

"Recombinant host cells", "host cells", "cells", "cell lines", "cell cultures", and other such terms denoting microorganisms or higher eukaryotic cell lines cultured as unicellular entities refer to cells which can be, or have been, used as recipients for recombinant vector or other transfer DNA, and include the progeny of the original cell which has been transfected. It is understood that the progeny of a single parental cell may not necessarily be completely identical in morphology or in genomic or total DNA complement as the original parent, due to natural, accidental, or deliberate mutation.

A "replicon" is any genetic element, e.g., a plasmid, a chromosome, a virus, a cosmid, etc. that behaves as an autonomous unit of polynucleotide replication within a cell; i.e., capable of replication under its own control.

A "vector" is a replicon in which another polynucleotide segment is attached, so as to bring about the replication and/or expression of the attached segment.

"Control sequence" refers to polynucleotide sequences which are necessary to effect the expression of coding sequences to which they are ligated. The nature of such control sequences differs depending upon the host organism; in prokaryotes, such control sequences generally include promoter, ribosomal binding site, and terminators; in eukaryotes, generally, such control sequences include promoters, terminators and, in some instances, enhancers. The term "control sequences" is intended to include, at a minimum, all components whose presence is necessary for expression, and may also include additional components whose presence is advantageous, for example, leader sequences.

"Operably linked" refers to a juxtaposition wherein the components so described are in a relationship permitting them to function in their intended manner. A control sequence "operably linked" to a coding sequence is ligated in such a way that expression of the coding sequence is achieved under conditions compatible with the control sequences.

An "open reading frame" (ORF) is a region of a polynucleotide sequence which encodes a polypeptide; this region may represent a portion of a coding sequence or a total coding sequence.

A "coding sequence" is a polynucleotide sequence which is transcribed into mRNA and/or translated into a polypeptide when placed under the control of appropriate regulatory sequences. The boundaries of the coding sequence are determined by a translation start codon at the 5'-terminus and a translation stop codon at the 3'-terminus. A coding sequence can include, but is not limited to mRNA, cDNA, and recombinant polynucleotide sequences.

"Immunologically identifiable with/as" refers to the presence of epitope(s) and polypeptides(s) which are also present in the designated polypeptide(s), usually HCV proteins. Immunological identity may be determined by antibody binding and/or competition in binding; these techniques are known to those of average skill in the art, and are also illustrated infra.

As used herein, "epitope" refers to an antigenic determinant of a polypeptide. An epitope could comprise 3 amino acids in a spatial conformation which is unique to the epitope. Generally an epitope consists of at least 5 such amino acids, and more usually, consists of at least 8–10 such amino acids. Methods of determining the spatial conformation of amino acids are known in the art, and include, for example, x-ray crystallography and 2-dimensional nuclear magnetic resonance.

A polypeptide is "immunologically reactive" with an antibody when it binds to an antibody due to antibody recognition of a specific epitope contained within the polypeptide. Immunological reactivity may be determined by antibody binding, more particularly by the kinetics of antibody binding, and/or by competition in binding using as competitor(s) a known polypeptide(s) containing an epitope against which the antibody is directed. The techniques for determining whether a polypeptide is immunologically reactive with an antibody are known in the art.

As used herein, the term "antibody" refers to a polypeptide or group of polypeptides which are comprised of at least one antibody combining site. An "antibody combining site" or "binding domain" is formed from the folding of variable domains of an antibody molecule(s) to form three-dimensional binding spaces with an internal surface shape and charge distribution complementary to the features of an epitope of an antigen, which allows an immunological reaction with the antigen. An antibody combining site may be formed from a heavy and/or a light chain domain ($V_H$ and $V_L$, respectively), which form hypervariable loops which contribute to antigen binding. The term "antibody" includes, for example, vertebrate antibodies, hybrid antibodies, chimeric antibodies, altered antibodies, univalent antibodies, the Fab proteins, and single domain antibodies.

As used herein, a "single domain antibody" (dAb) is an antibody which is comprised of an VH domain, which reacts immunologically with a designated antigen. A dAb does not contain a $V_L$ domain, but may contain other antigen binding domains known to exist in antibodies, for example, the kappa and lambda domains. Methods for preparing dAbs are known in the art. See, for example, Ward et al. (1989). Antibodies may also be comprised of $V_H$ and $V_L$ domains, as well as other known antigen binding domains. Examples of these types of antibodies and methods for their preparation are known in the art (see, e.g., U.S. Pat. No. 4,816,467, which is incorporated herein by reference), and include the following. For example, "vertebrate antibodies" refers to antibodies which are tetramers or aggregates thereof, comprising light and heavy chains which are usually aggregated in a "Y" configuration and which may or may not have covalent linkages between the chains. In vertebrate antibodies, the amino acid sequences of all the chains of a particular antibody are homologous with the chains found in one antibody produced by the lymphocyte which produces that antibody in situ, or in vitro (for example, in hybridomas). Vertebrate antibodies typically include native antibodies, for example, purified polyclonal antibodies and monoclonal antibodies. Examples of the methods for the preparation of these antibodies are described infra.

"Hybrid antibodies" are antibodies wherein one pair of heavy and light chains is homologous to those in a first antibody, while the other pair of heavy and light chains is homologous to those in a different second antibody. Typically, each of these two pairs will bind different epitopes, particularly on different antigens. This results in the property of "divalence", i.e., the ability to bind two antigens simultaneously. Such hybrids may also be formed using chimeric chains, as set forth below.

"Chimeric antibodies", are antibodies in which the heavy and/or light chains are fusion proteins. Typically the constant domain of the chains is from one particular species and/or class, and the variable domains are from a different species and/or class. Also included is any antibody in which either or both of the heavy or light chains are composed of combinations of sequences mimicking the sequences in antibodies of different sources, whether these sources be differing classes, or different species of origin, and whether or not the fusion point is at the variable/constant boundary. Thus, it is possible to produce antibodies in which neither the constant nor the variable region mimic known antibody sequences. It then becomes possible, for example, to construct antibodies whose variable region has a higher specific affinity for a particular antigen, or whose constant region can elicit enhanced complement fixation, or to make other improvements in properties possessed by a particular constant region.

Another example is "altered antibodies", which refers to antibodies in which the naturally occurring amino acid sequence in a vertebrate antibody has been varied. Utilizing recombinant DNA techniques, antibodies can be redesigned to obtain desired characteristics. The possible variations are many, and range from the changing of one or more amino acids to the complete redesign of a region, for example, the constant region. Changes in the constant region, in general, to attain desired cellular process characteristics, e.g., changes in complement fixation, interaction with membranes, and other effector functions. Changes in the variable region may be made to alter antigen binding characteristics. The antibody may also be engineered to aid the specific delivery of a molecule or substance to a specific cell or tissue site. The desired alterations may be made by known techniques in molecular biology, e.g., recombinant techniques, site directed mutagenesis, etc.

Yet another example are "univalent antibodies", which are aggregates comprised of a heavy chain/light chain dimer bound to the Fc (i.e., constant) region of a second heavy chain. This type of antibody escapes antigenic modulation. See, e.g., Glennie et al. (1982).

Included also within the definition of antibodies are "Fab" fragments of antibodies. The "Fab" region refers to those portions of the heavy and light chains which are roughly equivalent, or analogous, to the sequences which comprise the branch portion of the heavy and light chains, and which have been shown to exhibit immunological binding to a specified antigen, but which lack the effector Fc portion.

"Fab" includes aggregates of one heavy and one light chain (commonly known as Fab'), as well as tetramers containing the 2H and 2L chains (referred to as F(ab)$_2$), which are capable of selectively reacting with a designated antigen or antigen family. "Fab" antibodies may be divided into subsets analogous to those described above, i.e, "vertebrate Fab", "hybrid Fab", "chimeric Fab", and "altered Fab". Methods of producing "Fab" fragments of antibodies are known within the art and include, for example, proteolysis, and synthesis by recombinant techniques.

As used herein, the term "immunogenic polypeptide" is a polypeptide that elicits a cellular and/or humoral immune response, whether alone or linked to a carrier in the presence or absence of an adjuvant.

The term "polypeptide" refers to a polymer of amino acids and does not refer to a specific length of the product; thus, peptides, oligopeptides, and proteins are included within the definition of polypeptide. This term also does not refer to or exclude post-expression modifications of the polypeptide, for example, glycosylation, acetylation, phosphorylation and the like. Included within the definition are, for example, polypeptides containing one or more analogs of an amino acid (including, for example, unnatural amino acids, etc.), polypeptides with substituted linkages, as well as other modifications known in the art, both naturally occurring and non-naturally occurring.

"Transformation", as used herein, refers to the insertion of an exogenous polynucleotide into a host cell, irrespective of the method used for the insertion, for example, direct uptake, transduction, f-mating or electroporation. The exogenous polynucleotide may be maintained as a non-integrated vector, for example, a plasmid, or alternatively, may be integrated into the host genome.

"Treatment" as used herein refers to prophylaxis and/or therapy.

An "individual", as used herein, refers to vertebrates, particularly members of the mammalian species, and includes but is not limited to domestic animals, sports animals, and primates, including humans.

As used herein, the "sense strand" of a nucleic acid contains the sequence that has sequence homology to that of mRNA. The "anti-sense strand" contains a sequence which is complementary to that of the "sense strand".

As used herein, a "positive stranded genome" of a virus is one in which the genome, whether RNA or DNA, is single-stranded and which encodes a viral polypeptide(s). Examples of positive stranded RNA viruses include Togaviridae, Coronaviridae, Retroviridae, Picornaviridae, and Caliciviridae. Included also, are the Flaviviridae, which were formerly classified as Togaviradae. See Fields & Knipe (1986).

As used herein, "antibody containing body component" refers to a component of an individual's body which is a source of the antibodies of interest. Antibody containing body components are known in the art, and include but are not limited to, for example, plasma, serum, spinal fluid, lymph fluid, the external sections of the respiratory, intestinal, and genitourinary tracts, tears, saliva, milk, white blood cells, and myelomas.

As used herein, "purified HCV" refers to a preparation of HCV which has been isolated from the cellular constituents with which the virus is normally associated, and from other types of viruses which may be present in the infected tissue. The techniques for isolating viruses are known to those of skill in the art, and include, for example, centrifugation and affinity chromatography; a method of preparing purified HCV is discussed infra.

The term "HCV particles" as used herein include entire virion as well as particles which are intermediates in virion formation. HCV particles generally have one or more HCV proteins associated with the HCV nucleic acid.

As used herein, the term "probe" refers to a polynucleotide which forms a hybrid structure with a sequence in a target region, due to complementarity of at least one sequence in the probe with a sequence in the target region.

As used herein, the term "target region" refers to a region of the nucleic acid which is to be amplified and/or detected.

As used herein, the term "viral RNA", which includes HCV RNA, refers to RNA from the viral genome, fragments thereof, transcripts thereof, and mutant sequences derived therefrom.

As used herein, a "biological sample" refers to a sample of tissue or fluid isolated from an individual, including but not limited to, for example, plasma, serum, spinal fluid, lymph fluid, the external sections of the skin, respiratory, intestinal, and genitourinary tracts, tears, saliva, milk, blood cells, tumors, organs, and also samples of in vitro cell culture constituents (including but not limited to conditioned medium resulting from the growth of cells in cell culture medium, putatively virally infected cells, recombinant cells, and cell components).

II. Description of the Invention

The practice of the present invention will employ, unless otherwise indicated, conventional techniques of molecular biology, microbiology, recombinant DNA, and immunology, which are within the skill of the art. Such techniques are explained fully in the literature. See e.g., Maniatis, Fitsch & Sambrook, "Molecular Cloning; A Laboratory Manual" (1982); "DNA Cloning, Volumes I and II" (D. N Glover ed. 1985); "Oligonucleotide Synthesis" (M. J. Gait ed, 1984); "Nucleic Acid Hybridization" (B. D. Hames & S. J. Higgins eds. 1984); "Transcription and Translation" (B. D. Hames & S. J. Higgins eds. 1984); "Animal Cell Culture" (R. I. Freshney ed. 1986); "Immobilized Cells And Enzymes" (IRL Press, 1986); B. Perbal, "A Practical Guide To Molecular Cloning" (1984); the series, "Methods in Enzymology" (Academic Press, Inc.); "Gene Transfer Vectors For Mammalian Cells" (J. H. Miller and M. P. Calos eds. 1987, Cold Spring Harbor Laboratory), *Meth Enzymol* Vol. 154 and Vol. 155 (Wu and Grossman, and Wu, eds., respectively), Mayer and Walker, eds. (1987), "Immunochemical Methods In Cell And Molecular Biology" (Academic Press, London); Scopes, (1987) "Protein Purification: Principles and Practice", Second Edition (Springer-Verlag, N.Y.); and "Handbook of Experimental Immunology", Volumes I–IV (D. M. Weir and C. C. Blackwell eds 1986). All patents, patent applications, and publications mentioned herein, both supra and infra, are hereby incorporated herein by reference.

The useful materials and processes of the present invention are made possible by the provision of a family of closely homologous nucleotide sequences isolated from a cDNA library derived from nucleic acid sequences present in the plasma of an HCV infected chimpanzee. This family of nucleotide sequences is not of human or chimpanzee origin, since it hybridizes to neither human nor chimpanzee genomic DNA from uninfected individuals, since nucleotides of this family of sequences are present only in liver and plasma of chimpanzees with HCV infection, and since the sequence is not present in Genebank. In addition, the family of sequences shows no significant homology to sequences contained within the HBV genome.

The sequence of one member of the family, contained within clone 5-1-1, has one continuous open reading frame (ORF) which encodes a polypeptide of approximately 50 amino acids. Sera from HCV infected humans contain antibodies which bind to this polypeptide, whereas sera from non-infected humans do not contain antibodies to this polypeptide. Moreover, whereas the sera from uninfected chimpanzees do not contain antibodies to this polypeptide, the antibodies are induced in chimpanzees following acute NANBH infection. In addition, antibodies to this polypeptide are not detected in chimps and humans infected with HAV and HBV. By these criteria the sequence is a cDNA to a viral sequence, wherein the virus causes or is associated with NANBH; this cDNA sequence is shown in FIG. 1. As discussed infra, the cDNA sequence in clone 5-1-1 differs from that of the other isolated cDNAs in that it contains 28 extra base pairs.

A composite of other identified members of the cDNA family, which were isolated using as a probe a synthetic sequence equivalent to a fragment of the cDNA in clone 5-1-1, is shown in FIG. 3. A member of the cDNA family which was isolated using a synthetic sequence derived from the cDNA in clone 81 is shown in FIG. 5, and the composite of this sequence with that of clone 81 is shown in FIG. 6. Other members of the cDNA family are described in Section IV.A. A composite of the cDNAs in these clones is shown in FIG. 62. The composite cDNA shows that it contains one continuous ORF, and thus encodes a polyprotein. This data is consistent with the suggestion, discussed infra, that HCV is a flavi-like virus.

The availability of the family of cDNAs shown herein in Section IV.A permits the construction of DNA probes and polypeptides useful in diagnosing NANBH due to HCV infection and in screening blood donors as well as donated blood and blood products for infection. For example, from the sequences it is possible to synthesize DNA oligomers of about 8–10 nucleotides, or larger, which are useful as hybridization probes to detect the presence of HCV RNA in, for example, sera of subjects suspected of harboring the virus, or for screening donated blood for the presence of the virus. The family of cDNA sequences also allows the design and production of HCV specific polypeptides which are useful as diagnostic reagents for the presence of antibodies raised during NANBH. Antibodies to purified polypeptides derived from the cDNAs may also be used to detect viral antigens in infected individuals and in blood.

Knowledge of these cDNA sequences also enables the design and production of polypeptides which may be used as vaccines against HCV and also for the production of antibodies, which in turn may be used for protection against the disease, and/or for therapy of HCV infected individuals.

Moreover, the family of cDNA sequences enables further characterization of the HCV genome. Polynucleotide probes derived from these sequences may be used to screen cDNA libraries for additional overlapping cDNA sequences, which, in turn, may be used to obtain more overlapping sequences. Unless the genome is segmented and the segments lack common sequences, this technique may be used to gain the sequence of the entire genome. However, if the genome is segmented, other segments of the genome can be obtained by repeating the λgt11 serological screening procedure used to isolate the cDNA clones described herein, or alternatively by isolating the genome from purified HCV particles.

The family of cDNA sequences and the polypeptides derived from these sequences, as well as antibodies directed against these polypeptides are also useful in the isolation and identification of the BB-NANBV agent(s). For example, antibodies directed against HCV epitopes contained in polypeptides derived from the cDNAs may be used in processes based upon affinity chromatography to isolate the virus. Alternatively, the antibodies may be used to identify viral particles isolated by other techniques. The viral antigens and the genomic material within the isolated viral particles may then be further characterized.

The information obtained from further sequencing of the HCV genome(s), as well as from further characterization of the HCV antigens and characterization of the genome enables the design and synthesis of additional probes and polypeptides and antibodies which may be used for diagnosis, for prevention, and for therapy of HCV induced NANBH, and for screening for infected blood and blood-related products.

The availability of probes for HCV, including antigens and antibodies, and polynucleotides derived from the genome from which the family of cDNAs is derived also allows for the development of tissue culture systems which will be of major use in elucidating the biology of HCV. This in turn, may lead to the development of new treatment regimens based upon antiviral compounds which preferentially inhibit the replication of, or infection by HCV.

In addition to the above, the information provided infra allows the identification of additional HCV strains or isolates. The isolation and characterization of the additional HCV strains or isolates may be accomplished by isolating the nucleic acids from body components which contain viral particles and/or viral RNA, creating cDNA libraries using polynucleotide probes based on the HCV cDNA probes described infra, screening the libraries for clones containing HCV cDNA sequences described infra, and comparing the HCV cDNAs from the new isolates with the cDNAs described infra. The polypeptides encoded therein, or in the viral genome, may be monitored for immunological cross-reactivity utilizing the polypeptides and antibodies described supra. Strains or isolates which fit within the parameters of HCV, as described in the Definitions section, supra, are readily identifiable. Other methods for identifying HCV strains will be obvious to those of skill in the art, based upon the information provided herein.

The method used to identify and isolate the etiologic agent for NANBH may be applicable to the identification and/or isolation of heretofore uncharacterized agents which contain a genome, and which are associated with a variety of diseases, including those induced by viruses, viroids, bacteria, fungi and parasites. In this method, a cDNA library was created from the nucleic acids present in infected tissue from an infected individual. The library was created in a vector which allowed the expression of polypeptides encoded in the cDNA. Clones of host cells containing the vector, which expressed an immunologically reactive fragment of a polypeptide of the etiologic agent, were selected by immunological screening of the expression products of the library with an antibody-containing body component from another individual previously infected with the putative agent. The steps in the immunological screening technique included interacting the expression products of the cDNA containing vectors with the antibody-containing body component of a second infected individual, and detecting the formation of antibody-antigen complexes between the expression product(s) and antibodies of the second infected individual. The isolated clones are screened further immunologically by interacting their expression products with the antibody-containing body components of other individuals infected with the putative agent and with control individuals uninfected with the putative agent, and detecting the formation of antigen-antibody complexes with antibodies from the infected individuals; and the cDNA containing vectors which encode polypeptides which react immunologically with antibodies from infected individuals and individuals suspected of being infected with the agent, but not with control individuals are isolated. The infected individuals used for the construction of the cDNA library, and for the immunological screening need not be of the same species.

The cDNAs isolated as a result of this method, and their expression products, and antibodies directed against the expression products, are useful in characterizing and/or capturing the etiologic agent. As described in more detail infra, this method has been used successfully to isolate a family of cDNAs derived from the HCV genome.

II.A. Preparation of the cDNA Sequences

Pooled serum from a chimpanzee with chronic HCV infection and containing a high titer of the virus, i.e., at least $10^6$ chimp infectious doses/mL (CID/mL) was used to isolate viral particles; nucleic acids isolated from these particles was used as the template in the construction of a cDNA library to the viral genome. The procedures for isolation of putative HCV particles and for constructing the cDNA library in λgt11 is discussed in Section IV.A.1. λgt11 is a vector that has been developed specifically to express inserted cDNAs as fusion polypeptides with b-galactosidase and to screen large numbers of recombinant phage with specific antisera raised against a defined antigen. T. V. Huynh et al. (1985). The λgt11 cDNA library generated from a cDNA pool containing cDNA of approximate mean size of 200 base pairs was screened for encoded epitopes that could bind specifically with sera derived from patients who had previously experienced NANB hepatitis. Approximately $10^6$ phages were screened, and five positive phages were identified, purified, and then further tested for specificity of binding to sera from different humans and chimpanzees previously infected with the HCV agent. One of the phages, 5-1-1, bound 5 of the 8 human sera tested. This binding appeared selective for sera derived from patients with prior NANB hepatitis infections since 7 normal blood donor sera did not exhibit such binding.

The sequence of the cDNA in recombinant phage 5-1-1 was determined, and is shown in FIG. 1. The polypeptide encoded by this cloned cDNA, which is in the same translational frame as the N-terminal b-galactosidase moiety of the fusion polypeptide is shown above the nucleotide sequence. This translational ORF, therefore, encodes an epitope(s) specifically recognized by sera from patients with NANB hepatitis infections.

The availability of the cDNA in recombinant phage 5-1-1 has allowed for the isolation of other clones containing additional segments and/or alternative segments of cDNA to the viral genome. The λgt11 cDNA library described supra, was screened using a synthetic polynucleotide derived from the sequence of the cloned 5-1-1 cDNA. This screening yielded three other clones, which were identified as 81, 1-2 and 91; the cDNAs contained within these clones were sequenced. See Sections IV.A.3. and IV.A.4. The homologies between the four independent clones are shown in FIG. 2, where the homologies are indicated by the vertical lines. Sequences of nucleotides present uniquely in clones 5-1-1, 81, and 91 are indicated by small letters.

The cloned cDNAs present in recombinant phages in clones 5-1-1, 81, 1-2, and 91 are highly homologous, and differ in only two regions. First, nucleotide number 67 in clone 1-2 is a thymidine, whereas the other three clones contain a cytidine residue in this position. This substitution, however, does not alter the nature of the encoded amino acid.

The second difference between the clones is that clone 5-1-1 contains 28 base pairs at its 5'-terminus which are not present in the other clones. The extra sequence may be a 5'-terminal cloning artifact; 5'-terminal cloning artifacts are commonly observed in the products of cDNA methods.

Synthetic sequences derived from the 5'-region and the 3'-region of the HCV cDNA in clone 81 were used to screen and isolate cDNAs from the λgt11 NANBV cDNA library, which overlapped clone 81 cDNA (Section IV.A.5.). The sequences of the resulting cDNAs, which are in clone 36 and clone 32, respectively, are shown in FIG. 5 and FIG. 7.

Similarly, a synthetic polynucleotide based on the 5'-region of clone 36 was used to screen and isolate cDNAs from the λgt-11 NANBV cDNA library which overlapped clone 36 cDNA (Section IV.A.8.). A purified clone of recombinant phage-containing cDNA which hybridized to the synthetic polynucleotide probe was named clone 35 and the NANBV cDNA sequence contained within this clone is shown in FIG. 8.

By utilizing the technique of isolating overlapping cDNA sequences, clones containing additional upstream and downstream HCV cDNA sequences have been obtained. The isolation of these clones, is described infra in Section IV.A.

Analysis of the nucleotide sequences of the HCV cDNAs encoded within the isolated clones show that the composite cDNA contains one long continuous ORF. FIG. 62 shows the sequence of the composite cDNA from these clones, along with the putative HCV polypeptide encoded therein.

The description of the method to retrieve the cDNA sequences is mostly of historical interest. The resultant sequences (and their complements) are provided herein, and the sequences, or any portion thereof, could be prepared using synthetic methods, or by a combination of synthetic methods with retrieval of partial sequences using methods similar to those described herein.

The description above, of "walking" the genome by isolating overlapping cDNA sequences from the HCV λgt11 library provides one method by which cDNAs corresponding to the entire HCV genome may be isolated. However, given the information provided herein, other methods for isolating these cDNAs are obvious to one of skill in the art. Some of these methods are described in Section IV.A., infra.

II.B. Preparation of Viral Polypeptides and Fragments

The availability of cDNA sequences, either those isolated by utilizing the cDNA sequences described in Section IV.A, as discussed infra, or nucleotide sequences derived therefrom (including segments and modifications of the sequence), permits the construction of expression vectors encoding antigenically active regions of the polypeptide encoded in either strand. These antigenically active regions may be derived from coat or envelope antigens or from core antigens, or from antigens which are non-structural including, for example, polynucleotide binding proteins, polynucleotide polymerase(s), and other viral proteins required for the replication and/or assembly of the virus particle. Fragments encoding the desired polypeptides are derived from the cDNA clones using conventional restriction digestion or by synthetic methods, and are ligated into vectors which may, for example, contain portions of fusion sequences such as b-Galactosidase or superoxide dismutase (SOD), preferably SOD. Methods and vectors which are useful for the production of polypeptides which contain fusion sequences of SOD are described in European Patent Office Publication number 0196056, published Oct. 1, 1986. Vectors encoding fusion polypeptides of SOD and HCV polypeptides, i.e., $NANB_{5-1-1}$, $NANB_{81}$, and C100-3, which is encoded in a composite of HCV cDNAs, are described in Sections IV.B.1, IV.B.2, and IV.B.4, respectively. Any desired portion of the HCV cDNA containing an open reading frame, in either sense strand, can be obtained as a recombinant polypeptide, such as a mature or fusion protein; alternatively, a polypeptide encoded in the cDNA can be provided by chemical synthesis.

The DNA encoding the desired polypeptide, whether in fused or mature form, and whether or not containing a signal sequence to permit secretion, may be ligated into expression vectors suitable for any convenient host. Both eukaryotic and prokaryotic host systems are presently used in forming recombinant polypeptides, and a summary of some of the more common control systems and host cell lines is given in Section III.A., infra. The polypeptide is then isolated from lysed cells or from the culture medium and purified to the extent needed for its intended use. Purification may be by techniques known in the art, for example, differential extraction, salt fractionation, chromatography on ion exchange resins, affinity chromatography, centrifugation, and the like. See, for example, Methods in Enzymology for a variety of methods for purifying proteins. Such polypeptides can be used as diagnostics, or those which give rise to neutralizing antibodies may be formulated into vaccines. Antibodies raised against these polypeptides can also be used as diagnostics, or for passive immunotherapy. In addition, as discussed in Section II.J. herein below, antibodies to these polypeptides are useful for isolating and identifying HCV particles.

The HCV antigens may also be isolated from HCV virions. The virions may be grown in HCV infected cells in tissue culture, or in an infected host.

II.C. Preparation of Antigenic Polypeptides and Conjugation with Carrier

An antigenic region of a polypeptide is generally relatively small—typically 8 to 10 amino acids or less in length. Fragments of as few as 5 amino acids may characterize an antigenic region. These segments may correspond to regions of HCV antigen. Accordingly, using the cDNAs of HCV as a basis, DNAs encoding short segments of HCV polypeptides can be expressed recombinantly either as fusion proteins, or as isolated polypeptides. In addition, short amino acid sequences can be conveniently obtained by chemical synthesis. In instances wherein the synthesized polypeptide is correctly configured so as to provide the correct epitope, but is too small to be immunogenic, the polypeptide may be linked to a suitable carrier.

A number of techniques for obtaining such linkage are known in the art, including the formation of disulfide linkages using N-succinimidyl-3-(2-pyridylthio)propionate (SPDP) and succinimidyl 4-(N-maleimido-methyl) cyclohexane-1-carboxylate (SMCC) obtained from Pierce Company, Rockford, Ill., (if the peptide lacks a sulfhydryl group, this can be provided by addition of a cysteine residue.) These reagents create a disulfide linkage between themselves and peptide cysteine residues on one protein and an amide linkage through the epsilon-amino on a lysine, or other free amino group in the other. A variety of such disulfide/amide-forming agents are known. See, for example, *Immun Rev* (1982)62:185. Other bifunctional coupling agents form a thioether rather than a disulfide linkage. Many of these thio-ether-forming agents are commercially available and include reactive esters of 6-maleimidocaproic acid, 2-bromoacetic acid, 2-iodoacetic acid, 4-(N-maleimido-methyl)cyclohexane-1-carboxylic acid, and the like. The carboxyl groups can be activated by combining them with succinimide or 1-hydroxyl-2 nitro-4-sulfonic acid, sodium salt. Additional methods of coupling antigens employs the rotavirus/"binding peptide" system described in EPO Pub. No. 259,149; the disclosure of which is incorporated herein by reference. The foregoing list is not meant to be exhaustive, and modifications of the named compounds can clearly be used.

Any carrier may be used which does not itself induce the production of antibodies harmful to the host. Suitable carriers are typically large, slowly metabolized macromolecules such as proteins; polysaccharides, such as latex functionalized Sepharose®, agarose, cellulose, cellulose beads and the like; polymeric amino acids, such as polyglutamic acid, polylysine, and the like; amino acid copolymers; and inactive virus particles, see, for example, Section II.D. Especially useful protein substrates are serum albumins, keyhole limpet hemocyanin, immunoglobulin molecules, thyroglobulin, ovalbumin, tetanus toxoid, and other proteins well known to those skilled in the art.

In addition to full-length viral proteins, polypeptides comprising truncated HCV amino acid sequences encoding at least one viral epitope are useful immunological reagents. For example, polypeptides comprising such truncated sequences can be used as reagents in an immunoassay. These polypeptides also are candidate subunit antigens in compositions for antiserum production or vaccines. While these truncated sequences can be produced by various known treatments of native viral protein, it is generally preferred to make synthetic or recombinant polypeptides comprising an HCV sequence. Polypeptides comprising these truncated HCV sequences can be made up entirely of HCV sequences (one or more epitopes, either contiguous or noncontiguous), or HCV sequences and heterologous sequences in a fusion protein. Useful heterologous sequences include sequences that provide for secretion from a recombinant host, enhance the immunological reactivity of the HCV epitope(s), or facilitate the coupling of the polypeptide to an immunoassay support or a vaccine carrier. See, e.g., EPO Pub. No.116,201; U.S. Pat. No. 4,722,840; EPO Pub. No. 259,149; U.S. Pat. No. 4,629,783, the disclosures of which are incorporated herein by reference.

The size of polypeptides comprising the truncated HCV sequences can vary widely, the minimum size being a sequence of sufficient size to provide an HCV epitope, while the maximum size is not critical. For convenience, the maximum size usually is not substantially greater than that required to provide the desired HCV epitopes and function (s) of the heterologous sequence, if any. Typically, the truncated HCV amino acid sequence will range from about 5 to about 100 amino acids in length. More typically, however, the HCV sequence will be a maximum of about 50 amino acids in length, preferably a maximum of about 30 amino acids. It is usually desirable to select HCV sequences of at least about 10, 12 or 15 amino acids, up to a maximum of about 20 or 25 amino acids.

Figure 67A:
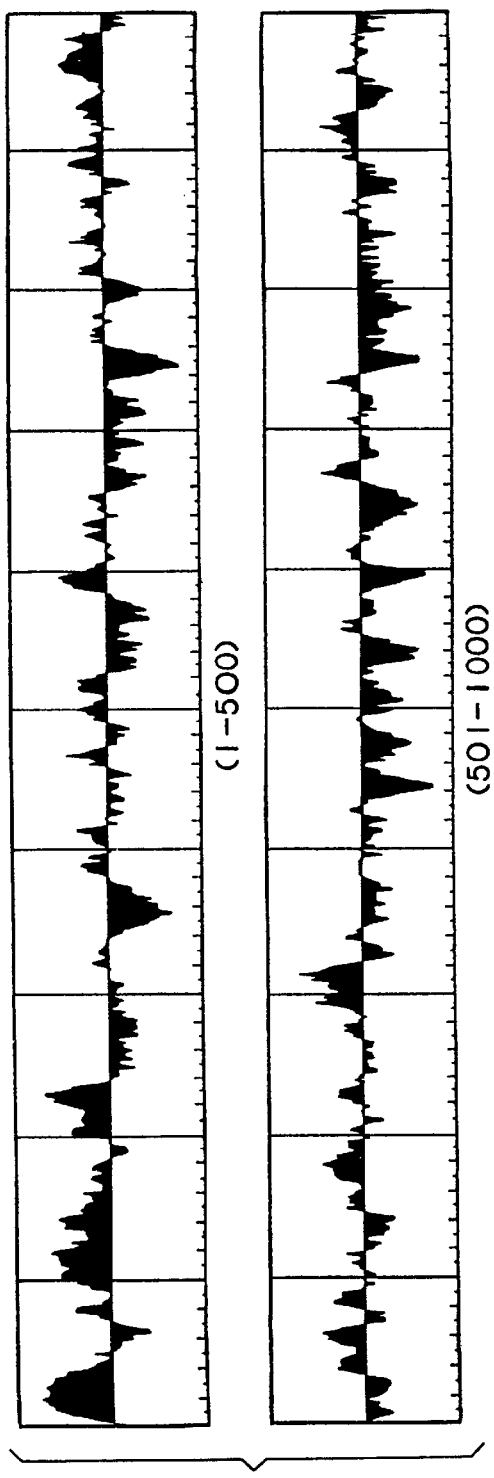
FIG. 67 is a tracing of the hydrophilicity/hydrophobicity profile and of the antigenic index of the putative HCV polyprotein.
Figure 67B:
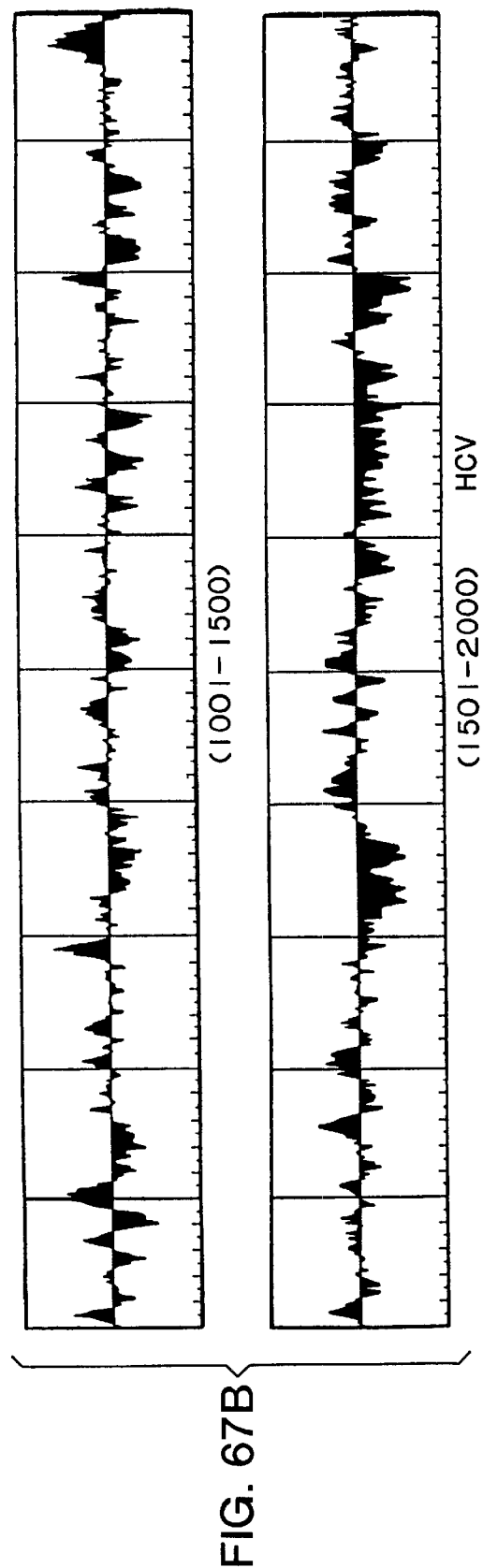

Truncated HCV amino acid sequences comprising epitopes can be identified in a number of ways. For example, the entire viral protein sequence can be screened by preparing a series of short peptides that together span the entire protein sequence. By starting with, for example, 100 mer polypeptides, it would be routine to test each polypeptide for the presence of epitope(s) showing a desired reactivity, and then testing progressively smaller and overlapping fragments from an identified 100 mer to map the epitope of interest. Screening such peptides in an immunoassay is within the skill of the art. It is also known to carry out a computer analysis of a protein sequence to identify potential epitopes, and then prepare oligopeptides comprising the identified regions for screening. Such a computer analysis of the HCV amino acid sequence is shown in FIG. 67, where the hydrophilic/hydrophobic character is displayed above the antigen index. The amino acids are numbered from the starting MET (position 1) as shown in FIG. 66. It is appreciated by those of skill in the art that such computer analysis of antigenicity does not always identify an epitope that actually exists, and can also incorrectly identify a region of the protein as containing an epitope.

Examples of HCV amino acid sequences that may be useful as described herein are set forth below. It is to be understood that these peptides do not necessarily precisely map one epitope, but may also contain HCV sequence that is not immunogenic. These non-immunogenic portions of the sequence can be defined as described above using conventional techniques and deleted from the described sequences. Further, additional truncated HCV amino acid sequences that comprise an epitope or are immunogenic can be identified as described above. The following sequences are given by amino acid number (i.e., "AAn") where n is the amino acid umber as shown in FIG. 66:

AA1-AA25; AA1-AA50; AA1-AA84; AA9-AA177; AA1-AA10; AA5-AA20; AA20-AA25; AA35-AA45; AA50-AA100; AA40-AA90; AA45-AA65; AA65-AA75; AA80-90; AA99-AA120; AA95-AA110; AA105-AA120; AA100-AA150; AA150-AA200; AA155-AA170; AA190-AA210; AA200-AA250; AA220-AA240; AA245-AA265; AA250-AA300; AA290-AA330; AA290-305; AA300-AA350; AA310-AA330; AA350-AA400; AA380-AA395; AA405-AA495; AA400-AA450; AA405-AA415; AA415-AA425; AA425-AA435; AA437-AA582; AA450-AA500; AA440-AA460; AA460-AA470; AA475-AA495; AA500-AA550; AA511-AA690; AA515-AA550; AA550-AA600; AA550-AA625; AA575-AA605; AA585-AA600; AA600-AA650; AA600-AA625; AA635-AA665; AA650-AA700; AA645-AA680; AA700-AA750; AA700-AA725; AA700-AA750; AA725-AA775; AA770-AA790; AA750-AA800; AA800-AA815; AA825-AA850; AA850-AA875; AA800-AA850; AA920-AA990; AA850-AA900; AA920-AA945; AA940-AA965; AA970-AA990; AA950-AA1000; AA1000-AA1060; AA1000-AA1025; AA1000-AA1050; AA1025-AA1040; AA1040-AA1055; AA1075-AA1175; AA1050-AA1200; AA1070-AA1100; AA1100-AA1130; AA1140-AA1165; AA1192-AA1457; AA1195-AA1250; AA1200-AA1225; AA1225-AA1250; AA1250-AA1300; AA1260-AA1310; AA1260-AA1280; AA1266-AA1428; AA1300-AA1350; AA1290-AA1310; AA1310-AA1340; AA1345-AA1405; AA1345-AA1365; AA1350-AA1400; AA1365-AA1380; AA1380-AA1405; AA1400-AA1450; AA1450-AA1500; AA1460-AA1475; AA1475-AA1515; AA1475-AA1500; AA1500-AA1550; AA1500-AA1515; AA1515-AA1550; AA1550-AA1600; AA1545-AA1560; AA1569-AA1931; AA1570-AA1590; AA1595-AA1610; AA1590-AA1650; AA1610-AA1645; AA1650-AA1690; AA1685-AA1770; AA1689-AA1805; AA1690-AA1720; AA1694-AA1735; AA1720-AA1745; AA1745-AA1770; AA1750-AA1800; AA1775-AA1810; AA1795-AA1850; AA1850-AA1900; AA1900-AA1950; AA1900-AA1920; AA1916-AA2021; AA1920-AA 1940; AA1949-AA2124; AA1950-AA2000; AA1950-AA1985; AA1980-AA2000; AA2000-AA2050; AA2005-AA2025; AA2020-AA2045; AA2045-AA2100; AA2045-AA2070; AA2054-AA2223; AA2070-AA2100; AA2100-AA2150; AA2150-AA2200; AA2200-AA2250; AA2200-AA2325; AA2250-AA2330; AA2255-AA2270; AA2265-AA2280; AA2280-AA2290; AA2287-AA2385; AA2300-AA2350; AA2290-AA2310; AA2310-AA2330; AA2330-AA2350; AA2350-AA2400; AA2348-AA2464; AA2345-AA2415; AA2345-AA2375; AA2370-AA2410; AA2371-AA2502; AA2400-AA2450; AA2400-AA2425; AA2415-AA2450; AA2445-AA2500; AA2445-AA2475; AA2470-AA2490; AA2500-AA2550; AA2505-AA2540; AA2535-AA2560; AA2550-AA2600; AA2560-AA2580; AA2600-AA2650; AA2605-AA2620; AA2620-AA2650; AA2640-AA2660; AA2650-AA2700; AA2655-AA2670; AA2670-AA2700; AA2700-AA2750; AA2740-AA2760; AA2750-AA2800; AA2755-AA2780; AA2780-AA2830; AA2785-AA2810; AA2796-AA2886; AA2810-AA2825; AA2800-AA2850; AA2850-AA2900; AA2850-AA2865; AA2885-AA2905; AA2900-AA2950; AA2910-AA2930; AA2925-AA2950; AA2945-end(C' terminal).

The above HCV amino acid sequences can be prepared as discrete peptides or incorporated into a larger polypeptide, and may find use as described herein. Additional polypeptides comprising truncated HCV sequences are described in the examples.

The observed relationship of the putative polyproteins of HCV and the Flaviviruses allows a prediction of the putative domains of the HCV "non-structural" (NS) proteins. The locations of the individual NS proteins in the putative Flavivirus precursor polyprotein are fairly well-known. Moreover, these also coincide with observed gross fluctuations in the hydrophobicity profile of the polyprotein. It is established that NS5 of Flaviviruses encodes the virion polymerase, and that NS1 corresponds with a complement fixation antigen which has been shown to be an effective vaccine in animals. Recently, it has been shown that a flaviviral protease function resides in NS3. Due to the observed similarities between HCV and the Flaviviruses, deductions concerning the approximate locations of the corresponding protein domains and functions in the HCV polyprotein are possible (see Section IV.H.6.). The expression of polypeptides containing these domains in a variety of recombinant host cells, including, for example, bacteria, yeast, insect, and vertebrate cells, should give rise to important immunological reagents which can be used for diagnosis, detection, and vaccines.

Although the non-structural protein region of the putative polyproteins of the HCV isolate described herein and of Flaviviruses appears to be generally similar, there is less similarity between the putative structural regions which are towards the N-terminus. In this region, there is a greater divergence in sequence, and in addition, the hydrophobic profile of the two regions show less similarity. This "divergence" begins in the N-terminal region of the putative NS1 domain in HCV, and extends to the presumed N-terminus. Nevertheless, it is still possible to predict the approximate locations of the putative nucleocapsid (N-terminal basic domain) and E (generally hydrophobic) domains within the HCV polyprotein. In Section IV.H.6., the predictions are based on the changes observed in the hydrophobic profile of the HCV polyprotein, and on a knowledge of the location and character of the flaviviral proteins. From these predictions it may be possible to identify approximate regions of the HCV polyprotein that could correspond with useful immunological reagents. For example, the E and NS1 proteins of Flaviviruses are known to have efficacy as protective vaccines. These regions, as well as some which are shown to be antigenic in the HCV isolate described herein, for example those within putative NS3, C, and NS5, etc., should also provide diagnostic reagents. Moreover, the location and expression of viral-encoded enzymes may also allow the evaluation of anti-viral enzyme inhibitors, i.e., for example, inhibitors which prevent enzyme activity by virtue of an interaction with the enzyme itself, or substances which may prevent expression of the enzyme, (for example, anti-sense RNA, or other drugs which interfere with expression).

II.D. Preparation of Hybrid Particle Immunogens Containing HCV Epitopes

The immunogenicity of the epitopes of HCV may also be enhanced by preparing them in mammalian or yeast systems fused with or assembled with particle-forming proteins such as, for example, that associated with hepatitis B surface antigen. See, e.g., U.S. Pat. No. 4,722,840. Constructs wherein the NANBV epitope is linked directly to the particle-forming protein coding sequences produce hybrids which are immunogenic with respect to the HCV epitope. In addition, all of the vectors prepared include epitopes specific to HBV, having various degrees of immunogenicity, such as, for example, the pre-S peptide. Thus, particles constructed from particle forming protein which include HCV sequences are immunogenic with respect to HCV and HBV.

Hepatitis surface antigen (HBSAg) has been shown to be formed and assembled into particles in *S. cerevisiae* (P. Valenzuela et al. (1982)), as well as in, for example, mammalian cells (P. Valenzuela et al. (1984)). The formation of such particles has been shown to enhance the immunogenicity of the monomer subunit. The constructs may also include the immunodominant epitope of HBSAg, comprising the 55 amino acids of the presurface (pre-S) region. Neurath et al (1984). Constructs of the pre-S-HBSAg particle expressible in yeast are disclosed in EPO 174,444, published Mar. 19, 1986; hybrids including heterologous viral sequences for yeast expression are disclosed in EPO 175,261, published Mar. 26, 1966. These constructs may also be expressed in mammalian cells such as Chinese hamster ovary (CHO) cells using an SV40-dihydrofolate reductase vector (Michelle et al. (1984)).

In addition, portions of the particle-forming protein coding sequence may be replaced with codons encoding an HCV epitope. In this replacement, regions which are not required to mediate the aggregation of the units to form immunogenic particles in yeast or mammals can be deleted, thus eliminating additional HBV antigenic sites from competition with the HCV epitope.

II.E. Preparation of Vaccines

Vaccines may be prepared from one or more immunogenic polypeptides derived from HCV. The observed homology between HCV and Flaviviruses provides information concerning the polypeptides which are likely to be most effective as vaccines, as well as the regions of the genome in which they are encoded. The general structure of the Flavivirus genome is discussed in Rice et al (1986). The flavivirus genomic RNA is believed to be the only virus-specific mRNA species, and it is translated into the three viral structural proteins, i.e., C, M, and E, as well as two large nonstructural proteins, NS4 and NS5, and a complex set of smaller nonstructural proteins. It is known that major neutralizing epitopes for Flaviviruses reside in the E (envelope) protein (Roehrig (1986)). The corresponding HCV E gene and polypeptide encoding region may be predicted, based upon the homology to Flaviviruses. Thus, vaccines may be comprised of recombinant polypeptides containing epitopes of HCV E. These polypeptides may be expressed in various host cells (e.g., bacteria, yeast, insect, or mammalian cells), or alternatively may be isolated from viral preparations. It is also anticipated that the other structural proteins may also contain epitopes which give rise to protective anti-HCV antibodies. Thus, polypeptides containing the epitopes of E, C, and M may also be used, whether singly or in combination, in HCV vaccines.

In addition to the above, it has been shown that immunization with NS1 (nonstructural protein 1), results in protection against yellow fever (Schlesinger et al (1986)). This is true even though the immunization does not give rise to neutralizing antibodies. Thus, particularly since this protein appears to be highly conserved among Flaviviruses, it is likely that HCV NS1 will also be protective against HCV infection. Moreover, it also shows that nonstructural proteins may provide protection against viral pathogenicity, even if they do not cause the production of neutralizing antibodies.

In view of the above, multivalent vaccines against HCV may be comprised of one or more epitopes from one or more structural proteins, and/or one or more epitopes from one or more nonstructural proteins. These vaccines may be comprised of, for example, recombinant HCV polypeptides and/or polypeptides isolated from the virions. In particular, vaccines are contemplated comprising one or more of the following HCV proteins, or subunit antigens derived therefrom: E, NS1, C, NS2, NS3, NS4 and NS5. Particularly preferred are vaccines comprising E and/or NS1, or subunits thereof. In addition, it may be possible to use inactivated HCV in vaccines; inactivation may be by the preparation of viral lysates, or by other means known in the art to cause inactivation of Flaviviruses, for example, treatment with organic solvents or detergents, or treatment with formalin. Moreover, vaccines may also be prepared from attenuated HCV strains. The preparation of attenuated HCV strains is described infra.

It is known that some of the proteins in Flaviviruses contain highly conserved regions. Thus, some immunological cross-reactivity is possible between HCV and other Flaviviruses. It is possible that shared epitopes between the Flaviviruses and HCV will give rise to protective antibodies against one or more of the disorders caused by these pathogenic agents. Thus, it may be possible to design multipurpose vaccines based upon this knowledge.

In addition to the above, it is also possible to prepare live vaccines of attenuated microorganisms which express one or more recombinant HCV polypeptides. Suitable attenuated microorganisms are known in the art and include, for example, viruses (e.g., vaccinia virus (see Brown et al. (1986)), as well as bacteria.

The preparation of vaccines which contain an immunogenic polypeptide(s) as active ingredients, is known to one skilled in the art. Typically, such vaccines are prepared as injectables, either as liquid solutions or suspensions; solid forms suitable for solution in, or suspension in, liquid prior to injection may also be prepared. The preparation may also be emulsified, or the protein encapsulated in liposomes. The active immunogenic ingredients are often mixed with excipients which are pharmaceutically acceptable and compatible with the active ingredient. Suitable excipients are, for example, water, saline, dextrose, glycerol, ethanol, or the like and combinations thereof. In addition, if desired, the vaccine may contain minor amounts of auxiliary substances such as wetting or emulsifying agents, pH buffering agents, and/or adjuvants which enhance the effectiveness of the vaccine. Examples of adjuvants which may be effective include but are not limited to: aluminum hydroxide, N-acetyl-muramyl-L-threonyl-D-isoglutamine (thr-MDP), N-acetyl-nor-muramyl-L-alanyl-D-isoglutamine (CGP 11637, referred to as nor-MDP), N-acetylmuramyl-L-alanyl-D-isoglutaminyl-L-alanine-2-(1'-2'-dipalmitoyl-sn-glycero-3-hydroxyphosphoryloxy)-ethylamine (CGP 19835A, referred to as MTP-PE), and RIBI, which contains three components extracted from bacteria, monophosphoryl lipid A, trehalose dimycolate and cell wall skeleton (MPL+TDM+CWS) in a 2% squalene/Tween® 80 emulsion. The effectiveness of an adjuvant may be determined by measuring the amount of antibodies directed against an immunogenic polypeptide containing an HCV antigenic sequence resulting from administration of this polypeptide in vaccines which are also comprised of the various adjuvants.

The vaccines are conventionally administered parenterally, by injection, for example, either subcutaneously or intramuscularly. Additional formulations which are suitable for other modes of administration include suppositories and, in some cases, oral formulations. For suppositories, traditional binders and carriers may include, for example, polyalkylene glycols or triglycerides; such suppositories may be formed from mixtures containing the active ingredient in the range of 0.5% to 10%, preferably 1%–2%. Oral formulations include such normally employed excipients as, for example, pharmaceutical grades of mannitol, lactose, starch, magnesium stearate, sodium saccharine, cellulose, magnesium carbonate, and the like. These compositions take the form of solutions, suspensions, tablets, pills, capsules, sustained release formulations or powders and contain 10%–95% of active ingredient, preferably 25%–70%.

The proteins may be formulated into the vaccine as neutral or salt forms. Pharmaceutically acceptable salts include the acid addition salts (formed with free amino groups of the peptide) and which are formed with inorganic acids such as, for example, hydrochloric or phosphoric acids, or such organic acids such as acetic, oxalic, tartaric, maleic, and the like. Salts formed with the free carboxyl groups may also be derived from inorganic bases such as, for example, sodium, potassium, ammonium, calcium, or ferric hydroxides, and such organic bases as isopropylamine, trimethylamine, 2-ethylamino ethanol, histidine, procaine, and the like.

II.F. Dosage and Administration of Vaccines

The vaccines are administered in a manner compatible with the dosage formulation, and in such amount as will be prophylactically and/or therapeutically effective. The quantity to be administered, which is generally in the range of 5 mg to 250 mg of antigen per dose, depends on the subject to be treated, capacity of the subject's immune system to synthesize antibodies, and the degree of protection desired. Precise amounts of active ingredient required to be administered may depend on the judgment of the practitioner and may be peculiar to each subject.

The vaccine may be given in a single dose schedule, or preferably in a multiple dose schedule. A multiple dose schedule is one in which a primary course of vaccination may be with 1–10 separate doses, followed by other doses given at subsequent time intervals required to maintain and or reinforce the immune response, for example, at 1–4 months for a second dose, and if needed, a subsequent dose(s) after several months. The dosage regimen will also, at least in part, be determined by the need of the individual and be dependent upon the judgment of the practitioner.

In addition, the vaccine containing the immunogenic HCV antigen(s) may be administered in conjunction with other immunoregulatory agents, for example, immune globulins.

II.G. Preparation of Antibodies Against HCV Epitopes

The immunogenic polypeptides prepared as described above are used to produce antibodies, including polyclonal and monoclonal. If polyclonal antibodies are desired, a selected mammal (e.g., mouse, rabbit, goat, horse, etc.) is immunized with an immunogenic polypeptide bearing an HCV epitope(s). Serum from the immunized animal is collected and treated according to known procedures. If serum containing polyclonal antibodies to an HCV epitope contains antibodies to other antigens, the polyclonal antibodies can be purified by immunoaffinity chromatography. Techniques for producing and processing polyclonal antisera are known in the art, see for example, Mayer and Walker (1987).

Alternatively, polyclonal antibodies may be isolated from a mammal which has been previously infected with HCV. An example of a method for purifying antibodies to HCV epitopes from serum from an infected individual, based upon affinity chromatography and utilizing a fusion polypeptide of SOD and a polypeptide encoded within cDNA clone 5-1-1, is presented in Section V.E.

Monoclonal antibodies directed against HCV epitopes can also be readily produced by one skilled in the art. The general methodology for making monoclonal antibodies by hybridomas is well known. Immortal antibody-producing cell lines can be created by cell fusion, and also by other techniques such as direct transformation of B lymphocytes with oncogenic DNA, or transfection with Epstein-Barr virus. See, e.g., M. Schreier et al. (1980); Hammerling et al. (1981); Kennett et al. (1980); see also, U.S. Pat. Nos. 4,341,761; 4,399,121; 4,427,783; 4,444,887; 4,466,917; 4,472,500; 4,491,632; and 4,493,890. Panels of monoclonal antibodies produced against HCV epitopes can be screened for various properties; i.e., for isotype, epitope affinity, etc.

Antibodies, both monoclonal and polyclonal, which are directed against HCV epitopes are particularly useful in diagnosis, and those which are neutralizing are useful in passive immunotherapy. Monoclonal antibodies, in particular, may be used to raise anti-idiotype antibodies.

Anti-idiotype antibodies are immunoglobulins which carry an "internal image" of the antigen of the infectious agent against which protection is desired. See, for example, Nisonoff, A., et al. (1981) and Dreesman et al. (1985). Techniques for raising anti-idiotype antibodies are known in the art. See, for example, Grzych (1985), MacNamara et al. (1984), and Vytdehaag et al. (1985). These anti-idiotype antibodies may also be useful for treatment, vaccination and/or diagnosis of NANBH, as well as for an elucidation of the immunogenic regions of HCV antigens.

II.H. Diagnostic Oligonucleotide Probes and Kits

Using the disclosed portions of the isolated HCV cDNAs as a basis, including those described in Section IV.A, oligomers of approximately 8 nucleotides or more can be prepared, either by excision from recombinant polynucleotides or synthetically, which hybridize with the HCV genome and are useful in identification of the viral agent(s), further characterization of the viral genome(s), as well as in detection of the virus(es) in diseased individuals. The probes for HCV polynucleotides (natural or derived) are a length which allows the detection of unique viral sequences by hybridization. While 6–8 nucleotides may be a workable length, sequences of 10–12 nucleotides are preferred, and about 20 nucleotides appears optimal. Preferably, these sequences will derive from regions which lack heterogeneity. These probes can be prepared using routine methods, including automated oligonucleotide synthetic methods. Among useful probes, for example, are the clone 5-1-1 and the additional clones disclosed herein, as well as the various oligomers useful in probing cDNA libraries, set forth below. A complement to any unique portion of the HCV genome will be satisfactory. For use as probes, complete complementarity is desirable, though it may be unnecessary as the length of the fragment is increased.

For use of such probes as diagnostics, the biological sample to be analyzed, such as blood or serum, may be treated, if desired, to extract the nucleic acids contained therein. The resulting nucleic acid from the sample may be subjected to gel electrophoresis or other size separation techniques; alternatively, the nucleic acid sample may be dot blotted without size separation. The probes are usually labeled. Suitable labels, and methods for labeling probes are known in the art, and include, for example, radioactive labels incorporated by nick translation or kinasing, biotin, fluorescent probes, and chemiluminescent probes. The nucleic acids extracted from the sample are then treated with the labeled probe under hybridization conditions of suitable stringencies.

The probes can be made completely complementary to the HCV genome. Therefore, usually high stringency conditions are desirable in order to prevent false positives. However, as shown infra, portions of the HCV genome are variable. Therefore, conditions of high stringency should only be used if the probes are complementary to regions of the viral genome which lack heterogeneity. The stringency of hybridization is determined by a number of factors during hybridization and during the washing procedure, including temperature, ionic strength, length of time, and concentration of formamide. These factors are outlined in, for example, Maniatis, T. (1982).

Generally, it is expected that the HCV genome sequences will be present in serum of infected individuals at relatively low levels, i.e., at approximately $10^2$–$10^3$ chimp infectious doses (CID) per mL. This level may require that amplification techniques be used in hybridization assays. Such techniques are known in the art. For example, the Enzo Biochemical Corporation "Bio-Bridge" system uses terminal deoxynucleotide transferase to add unmodified 3'-poly-dT-tails to a DNA probe. The poly dT-tailed probe is hybridized to the target nucleotide sequence, and then to a biotin-modified poly-A. PCT application 84/03520 and EPA124221 describe a DNA hybridization assay in which: (1) analyte is annealed to a single-stranded DNA probe that is complementary to an enzyme-labeled oligonucleotide; and (2) the resulting tailed duplex is hybridized to an enzyme-labeled oligonucleotide. EPA 204510 describes a DNA hybridization assay in which analyte DNA is contacted with a probe that has a tail, such as a poly-dT tail, an amplifier strand that has a sequence that hybridizes to the tail of the probe, such as a poly-A sequence, and which is capable of binding a plurality of labeled strands. A particularly desirable technique may first involve amplification of the target HCV sequences in sera approximately 10,000 fold, i.e., to approximately $10^6$ sequences/mL. This may be accomplished, for example, by the polymerase chain reactions (PCR) technique described which is by Saiki et al. (1986), by Mullis, U.S. Pat. No. 4,683,195, and by Mullis et al. U.S. Pat. No. 4,683,202. The amplified sequence(s) may then be detected using a hybridization assay which is described in co-pending U.S. Ser. No. 109,282 (Attorney Docket No. 2300-0171), which was filed Oct. 15, 1987, U.S. Ser. No.185,201 (filed Apr. 22, 1988), and U.S. Ser. No.252, 638 (filed Sep. 30, 1988), which are assigned to the herein assignee, and are hereby incorporated herein by reference. These hybridization assays, which should detect sequences at the level of $10^6$/mL, utilize nucleic acid multimers which bind to single-stranded analyte nucleic acid, and which also bind to a multiplicity of single-stranded labeled oligonucleotides. A suitable solution phase sandwich assay which may be used with labeled polynucleotide probes, and the methods for the preparation of probes is described in EPO 225,807, published Jun. 16, 1987, which is assigned to the herein assignee, and which is hereby incorporated herein by reference.

The probes can be packaged into diagnostic kits. Diagnostic kits include the probe DNA, which may be labeled; alternatively, the probe DNA may be unlabeled and the ingredients for labeling may be included in the kit in separate containers. The kit may also contain other suitably packaged reagents and materials needed for the particular hybridization protocol, for example, standards, as well as instructions for conducting the test.

II.I. Immunoassay and Diagnostic Kits

Both the polypeptides which react immunologically with serum containing HCV antibodies, for example, those derived from, expressed from, or encoded within the clones described in Section IV.A., and composites thereof, (see section IV.A.) and the antibodies raised against the HCV specific epitopes in these polypeptides, see for example Section IV.E, are useful in immunoassays to detect presence of HCV antibodies, or the presence of the virus and/or viral antigens, in biological samples. Design of the immunoassays is subject to a great deal of variation, and many formats are known in the art. The immunoassay will utilize at least one viral epitope derived from HCV. In one embodiment, the immunoassay uses a combination of viral epitopes derived from HCV. These epitopes may be derived from the same or from different viral polypeptides, and may be in separate recombinant or natural polypeptides, or together in the same recombinant polypeptides. An immunoassay may use, for example, a monoclonal antibody directed towards a viral epitope(s), a combination of monoclonal antibodies directed towards epitopes of one viral antigen, monoclonal antibodies directed towards epitopes of different viral antigens, polyclonal antibodies directed towards the same viral antigen, or polyclonal antibodies directed towards different viral antigens. Protocols may be based, for example, upon competition, or direct reaction, or sandwich type assays. Protocols may also, for example, use solid supports, or may be by immunoprecipitation. Most assays involve the use of labeled antibody or polypeptide; the labels may be, for example, enzymatic, fluorescent, chemiluminescent, radioactive, or dye molecules. Assays which amplify the signals from the probe are also known; examples of which are assays which utilize biotin and avidin, and enzyme-labeled and mediated immunoassays, such as ELISA assays.

Typically, an immunoassay for an anti-HCV antibody(s) will involve selecting and preparing the test sample suspected of containing the antibodies, such as a biological sample, then incubating it with an antigenic (i.e., epitope-containing) HCV polypeptide(s) under conditions that allow antigen-antibody complexes to form, and then detecting the formation of such complexes. Suitable incubation conditions are well known in the art. The immunoassay may be, without limitations, in a heterogeneous or in a homogeneous format, and of a standard or competitive type.

In a heterogeneous format, the polypeptide is typically bound to a solid support to facilitate separation of the sample from the polypeptide after incubation. Examples of solid supports that can be used are nitrocellulose (e.g., in membrane or microtiter well form), polyvinyl chloride (e.g., in sheets or microtiter wells), polystyrene latex (e.g., in beads or microtiter plates, polyvinylidine fluoride (known as Immulon®), diazotized paper, nylon membranes, activated beads, and Protein A beads. For example, Dynatech Immulon® 1 or Immulon® 2 microtiter plates or 0.25 inch polystyrene beads (Precision Plastic Ball) can be used in the heterogeneous format. The solid support containing the antigenic polypeptide is typically washed after separating it from the test sample, and prior to detection of bound antibodies. Both standard and competitive formats are known in the art.

In a homogeneous format, the test sample is incubated with antigen in solution. For example, it may be under conditions that will precipitate any antigen-antibody complexes which are formed. Both standard and competitive formats for these assays are known in the art.

In a standard format, the amount of HCV antibodies forming the antibody-antigen complex is directly monitored. This may be accomplished by determining whether labeled anti-xenogenic (e.g., anti-human) antibodies which recognize an epitope on anti-HCV antibodies will bind due to complex formation. In a competitive format, the amount of HCV antibodies in the sample is deduced by monitoring the competitive effect on the binding of a known amount of labeled antibody (or other competing ligand) in the complex.

Complexes formed comprising anti-HCV antibody (or, in the case of competitive assays, the amount of competing antibody) are detected by any of a number of known techniques, depending on the format. For example, unlabeled HCV antibodies in the complex may be detected using a conjugate of antixenogeneic Ig complexed with a label, (e.g., an enzyme label).

In immunoassays where HCV polypeptides are the analyte, the test sample, typically a biological sample, is incubated with anti-HCV antibodies under conditions that allow the formation of antigen-antibody complexes. Various formats can be employed. For example, a "sandwich assay" may be employed, where antibody bound to a solid support is incubated with the test sample; washed; incubated with a second, labeled antibody to the analyte, and the support is washed again. Analyte is detected by determining if the second antibody is bound to the support. In a competitive format, which can be either heterogeneous or homogeneous, a test sample is usually incubated with antibody and a labeled, competing antigen is also incubated, either sequentially or simultaneously. These and other formats are well known in the art.

The Flavivirus model for HCV allows predictions regarding the likely location of diagnostic epitopes for the virion structural proteins. The C, pre-M, M, and E domains are all likely to contain epitopes of significant potential for detecting viral antigens, and particularly for diagnosis. Similarly, domains of the nonstructural proteins are expected to contain important diagnostic epitopes (e.g., NS5 encoding a putative polymerase; and NS1 encoding a putative complement-binding antigen). Recombinant polypeptides, or viral polypeptides, which include epitopes from these specific domains may be useful for the detection of viral antibodies in infections blood donors and infected patients.

In addition, antibodies directed against the E and/or M proteins can be used in immunoassays for the detection of viral antigens in patients with HCV caused NANBH, and in infectious blood donors. Moreover, these antibodies may be extremely useful in detecting acute-phase donors and patients.

Some of the antigenic regions of the putative polyprotein have been mapped and identified by screening the antigenicity of bacterial expression products of HCV cDNAs which encode portions of the polyprotein. See Section IV.B.8. Other antigenic regions of HCV may be detected by expressing the portions of the HCV cDNAs in other expression systems, including yeast systems and cellular systems derived from insects and vertebrates. In addition, studies giving rise to an antigenicity index and hydrophobicity/hydrophilicity profile give rise to information concerning the probability of a region's antigenicity.

The studies on antigenic mapping by expression of HCV cDNAs showed that a number of clones containing these cDNAs expressed polypeptides which were immunologically reactive with serum from individuals with NANBH.

No single polypeptide was immunologically reactive with all sera. Five of these polypeptides were very immunogenic in that antibodies to the HCV epitopes in these polypeptides were detected in many different patient sera, although the overlap in detection was not complete. Thus, the results on the immunogenicity of the polypeptides encoded in the various clones suggest that efficient detection systems for HCV infection may include the use of panels of epitopes. The epitopes in the panel may be constructed into one or multiple polypeptides. The assays for the varying epitopes may be sequential or simultaneous.

Kits suitable for immunodiagnosis and containing the appropriate labeled reagents are constructed by packaging the appropriate materials, including the polypeptides of the invention containing HCV epitopes or antibodies directed against HCV epitopes in suitable containers, along with the remaining reagents and materials required for the conduct of the assay, as well as a suitable set of assay instructions.

II.J. Further Characterization of the HCV Genome Virions, and Viral Antigens Using Probes Derived From cDNA to the Viral Genome The HCV cDNA sequence information in the clones described in Section IV.A may be used to gain further information on the sequence of the HCV genome, and for identification and isolation of the HCV agent, and thus will aid in its characterization including the nature of the genome, the structure of the viral particle, and the nature of the antigens of which it is composed. This information, in turn, can lead to additional polynucleotide probes, polypeptides derived from the HCV genome, and antibodies directed against HCV epitopes which would be useful for the diagnosis and/or treatment of HCV caused NANBH.

The cDNA sequence information in the above-mentioned clones is useful for the design of probes for the isolation of additional cDNA sequences which are derived from as yet undefined regions of the HCV genome(s) from which the cDNAs in clones described in Section IV.A. are derived. For example, labeled probes containing a sequence of approximately 8 or more nucleotides, and preferably 20 or more nucleotides, which are derived from regions close to the 5'-termini or 3'-termini of the family of HCV cDNA sequences shown in FIGS. 1, 3, 6, 9, 14 and 62 may be used to isolate overlapping cDNA sequences from HCV cDNA libraries. These sequences which overlap the cDNAs in the above-mentioned clones, but which also contain sequences derived from regions of the genome from which the cDNA in the above mentioned clones are not derived, may then be used to synthesize probes for identification of other overlapping fragments which do not necessarily overlap the cDNAs in the clones described in Section IV.A. Unless the HCV genome is segmented and the segments lack common sequences, it is possible to sequence the entire viral genome (s) utilizing the technique of isolation of overlapping cDNAs derived from the viral genome(s). Although it is unlikely, if the genome is a segmented genome which lacks common sequences, the sequence of the genome can be determined by serologically screening λgt11 HCV cDNA libraries, as used to isolate clone 5-1-1, sequencing cDNA isolates, and using the isolated cDNAs to isolate overlapping fragments, using the technique described for the isolation and sequencing of the clones described in Section IV.A. Alternatively, characterization of the genomic segments could be from the viral genome(s) isolated from purified HCV particles. Methods for purifying HCV particles and for detecting them during the purification procedure are described herein, infra. Procedures for isolating polynucleotide genomes from viral particles are known in the art, and one procedure which may be used is shown in Example IV.A.1. The isolated genomic segments could then be cloned and sequenced. Thus, with the information provided herein, it is possible to clone and sequence the HCV genome(s) irrespective of their nature.

Methods for constructing cDNA libraries are known in the art, and are discussed supra and infra; a method for the construction of HCV cDNA libraries in λgt11 is discussed infra in Section IV.A. However, cDNA libraries which are useful for screening with nucleic acid probes may also be constructed in other vectors known in the art, for example, λgt10 (Huynh et al. (1985)). The HCV derived cDNA detected by the probes derived from the cDNAs described in Section IV.A, and from the probes synthesized from polynucleotides derived from these cDNAs, may be isolated from the clone by digestion of the isolated polynucleotide with the appropriate restriction enzyme(s), and sequenced. See, for example, Section IV.A.3. and IV.A.4. for the techniques used for the isolation and sequencing of HCV cDNA which overlaps HCV cDNA in clone 5-1-1, Sections IV.A.5–IV.A.7 for the isolation and sequencing of HCV cDNA which overlaps that in clone 81, and Section IV.A.8 and IV.A.9 for the isolation and sequencing of a clone which overlaps another clone (clone 36), which overlaps clone 81.

The sequence information derived from these overlapping HCV cDNAs is useful for determining areas of homology and heterogeneity within the viral genome(s), which could indicate the presence of different strains of the genome, and/or of populations of defective particles. It is also useful for the design of hybridization probes to detect HCV or HCV antigens or HCV nucleic acids in biological samples, and during the isolation of HCV (discussed infra), utilizing the techniques described in Section II.G. Moreover, the overlapping cDNAs may be used to create expression vectors for polypeptides derived from the HCV genome(s) which also encode the polypeptides encoded in clones 5-1-1, 36, 81, 91, and 1-2, and in the other clones described in Section IV.A. The techniques for the creation of these polypeptides containing HCV epitopes, and for antibodies directed against HCV epitopes contained within them, as well as their uses, are analogous to those described for polypeptides derived from NANBV cDNA sequences contained within the HCV cDNA clones described in Section IV.A, discussed supra and infra.

Encoded within the family of cDNA sequences contained within clones 5-1-1, 32, 35, 36, 81, 91, 1-2, and the other clones described in Section IV.A. are antigen(s) containing epitopes which appear to be unique to HCV; i.e., antibodies directed against these antigens are absent from individuals infected with HAV or HBV, and from individuals not infected with HCV (see the serological data presented in Section IV.B.). Moreover, a comparison of the sequence information of these cDNAs with the sequences of HAV, HBV, HDV, and with the genomic sequences in Genebank indicates that minimal homology exists between these cDNAs and the polynucleotide sequences of those sources. Thus, antibodies directed against the antigens encoded within the cDNAs of these clones may be used to identify BB-NANBV particles isolated from infected individuals. In addition, they are also useful for the isolation of NANBH agent(s).

HCV particles may be isolated from the sera from individuals with NANBH or from cell cultures by any of the methods known in the art, including for example, techniques based on size discrimination such as sedimentation or exclusion methods, or techniques based on density such as ultracentrifugation in density gradients, or precipitation with agents such as polyethylene glycol, or chromatography on a variety of materials such as anionic or cationic exchange materials, and materials which bind due to hydrophobicity, as well as affinity columns. During the isolation procedure the presence of HCV may be detected by hybridization analysis of the extracted genome, using probes derived from the HCV cDNAs described supra, or by immunoassay (see Section II.I.) utilizing as probes antibodies directed against HCV antigens encoded within the family of cDNA sequences described in Section IV.A, and also directed against HCV antigens encoded within the overlapping HCV cDNA sequences discussed supra. The antibodies may be monoclonal, or polyclonal, and it may be desirable to purify the antibodies before their use in the immunoassay. A purification procedure for polyclonal antibodies directed against antigen(s) encoded within clone 5-1-1 is described in Section IV.E; analogous purification procedures may be utilized for antibodies directed against other HCV antigens.

Antibodies directed against HCV antigens encoded within the family of cDNAs described in Section IV.A, as well as those encoded within overlapping HCV cDNAs, which are affixed to solid supports are useful for the isolation of HCV by immunoaffinity chromatography. Techniques for immunoaffinity chromatography are known in the art, including techniques for affixing antibodies to solid supports so that they retain their immunoselective activity; the techniques may be those in which the antibodies are adsorbed to the support (see, for example, Kurstak in "Enzyme Immunodiagnosis", pp. 31–37), as well as those in which the antibodies are covalently linked to the support. Generally, the techniques are similar to those used for covalent linking of antigens to a solid support, which are generally described in Section II.C.; however, spacer groups may be included in the bifunctional coupling agents so that the antigen binding site of the antibody remains accessible.

During the purification procedure the presence of HCV may be detected and/or verified by nucleic acid hybridization, utilizing as probes polynucleotides derived from the family of HCV cDNA sequences described in Section IV.A, as well as from overlapping HCV cDNA sequences, described supra. In this case, the fractions are treated under conditions which would cause the disruption of viral particles, for example, with detergents in the presence of chelating agents, and the presence of viral nucleic acid determined by hybridization techniques described in Section II.H. Further confirmation that the isolated particles are the agents which induce HCV may be obtained by infecting chimpanzees with the isolated virus particles, followed by a determination of whether the symptoms of NANBH result from the infection.

Viral particles from the purified preparations may then be further characterized. The genomic nucleic acid has been purified. Based upon its sensitivity to RNase, and not DNase I, it appears that the virus is composed of an RNA genome. See Example IV.C.2., infra. The strandedness and circularity or non-circularity can determined by techniques known in the art, including, for example, its visualization by electron microscopy, its migration in density gradients, and its sedimentation characteristics. Based upon the hybridization of the captured HCV genome to the negative strands of HCV cDNAs, it appears that HCV may be comprised of a positive stranded RNA genome (see Section IV.H.1). Techniques such as these are described in, for example, *Meth Enzymol.* In addition, the purified nucleic acid can be cloned and sequenced by known techniques, including reverse transcription since the genomic material is RNA. See, for example, Maniatis (1982), and Glover (1985). Utilizing the nucleic acid derived from the viral particles, it is possible to sequence the entire genome, whether or not it is segmented.

Examination of the homology of the polypeptide encoded within the continuous ORF of combined clones 14i through 39c (the ORF is shown in FIG. 26), suggests that a portion of the HCV polypeptide contains regions of homology with the corresponding proteins in conserved regions of flaviviruses. An example of this is described in Section IV.H.3. This evidence, in conjunction with the results which show that HCV contains a positive-stranded genome, the size of which is approximately 10,000 nucleotides, is consistent with the suggestion that HCV is distantly related to the flaviviridae. Generally, flavivirus virions and their genomes have a relatively consistent structure and organization, which are known. See Rice et al. (1986), and Brinton, M. A. (1988). Using the comparison with flaviviruses, predictions as to the location of the sequences encoding some of the HCV proteins may be made.

The structure of the HCV may also be determined and its components isolated. The morphology and size may be determined by, for example, electron microscopy. The identification and localization of specific viral polypeptide antigens such as coat or envelope antigens, or internal antigens, such as nucleic acid binding proteins, core antigens, and polynucleotide polymerase(s) may also be determined by, for example, determining whether the antigens are present as major or minor viral components, as well as by utilizing antibodies directed against the specific antigens encoded within isolated cDNAs as probes. This information is useful in the design of vaccines; for example, it may be preferable to include an exterior antigen in a vaccine preparation. Multivalent vaccines may be comprised of, for example, an epitope derived from the genome encoding a structural protein, for example, E, as well as an epitope from another portion of the genome, for example, a nonstructural or structural polypeptide.

II.K. Cell Culture Systems and Animal Model Systems for HCV Replication

The suggestion that HCV is a flavi-like virus also provides information on methods for growing HCV. The virus is thought to be "Flavi-like" for several reasons. Based upon the HCV cDNA sequence, the genome appears to contain a large ORF which encodes a putative polyprotein. The HCV genome is positive-stranded with respect to translation of this polyprotein. The hydrophobicity profile of the HCV polyprotein resembles in particular that of putative polyproteins from known Flaviviruses. The apparent size of the genome, approximately 10,000 nucleotides in size, may be smaller than, but is close to that of known Flaviviruses. Although there is only a slight amount of amino acid homology between the HCV putative polyprotein and that of Flaviviruses, the homology is probably significant because there appear to be at three conserved motifs that have similar spacing in HCV and the Flaviviruses. Two of these conserved motifs, which are of larger size, are in the putative NS3 region. A third conserved motif is in putative NS5; the conserved sequence in this region, GDD, is usually associated with a Flavivirus polymerase. Other regions which are conserved between the Flaviviruses are also partially conserved in HCV. Methods for culturing flaviviruses are known to those of skill in the art (see, for example, the reviews by Brinton (1986) and Stollar, V. (1980)). Generally, suitable cells or cell lines for culturing HCV may include those known to support Flavivirus replication, for example, the following: monkey kidney cell lines (e.g. MK$_2$, VERO); porcine kidney cell lines (e.g. PS); baby hamster kidney cell lines (e.g. BHK); murine macrophage cell lines (e.g., P388D1, MK1, Mm1); human macrophage cell lines (e.g., U-937); human peripheral blood leukocytes; human adherent monocytes; hepatocytes or hepatocyte cell lines (e.g., HUH7, HEPG2); embryos or embryonic cells (e.g., chick embryo fibroblasts); or cell lines derived from invertebrates, preferably from insects (e.g. drosophila cell lines), or more preferably from arthropods, for example, mosquito cell lines (e.g., *A. Albopictus, Aedes aegypti, Cutex tritaeniorhynchus*) or tick cell lines (e.g. RML-14 *Dermacentor parumapertus*).

It is possible that primary hepatocytes can be cultured, and then infected with HCV; or alternatively, the hepatocyte cultures could be derived from the livers of infected individuals (e.g., humans or chimpanzees). The latter case is an example of a cell which is infected in vivo being passaged in vitro. In addition, various immortalization methods can be used to obtain cell-lines derived from hepatocyte cultures. For example, primary liver cultures (before and after enrichment of the hepatocyte population) may be fused to a variety of cells to maintain stability. For example, also, cultures may be infected with transforming viruses, or transfected with transforming genes in order to create permanent or semi-permanent cell lines. In addition, for example, cells in liver cultures may be fused to established cell lines (e.g., HepG2). Methods for cell fusion are known in the art, and include, for example, the use of fusion agents such as polyethylene glycol, Sendai Virus, and Epstein-Barr virus.

As discussed above, HCV is a Flavi-like virus. Therefore, it is probable that HCV infection of cell lines may be accomplished by techniques known in the art for infecting cells with Flaviviruses. These include, for example, incubating the cells with viral preparations under conditions which allow viral entry into the cell. In addition, it may be possible to obtain viral production by transfecting the cells with isolated viral polynucleotides. It is known that Togavirus and Flavivirus RNAs are infectious in a variety of vertebrate cell lines (Pfefferkorn and Shapiro (1974)), and in a mosquito cell line (Peleg (1969)). Methods for transfecting tissue culture cells with RNA duplexes, positive stranded RNAs, and DNAs (including cDNAs) are known in the art, and include, for example, techniques which use electroporation, and precipitation with DEAE-Dextran or calcium phosphate. An abundant source of HCV RNA can be obtained by performing in vitro transcription of an HCV cDNA corresponding to the complete genome. Transfection with this material, or with cloned HCV cDNA should result in viral replication and the in vitro propagation of the virus.

In addition to cultured cells, animal model systems may be used for viral replication; animal systems in which flaviviruses are known to those of skill in the art (see, for example, the review by Monath (1986)). Thus, HCV replication may occur not only in chimpanzees, but also in, for example, marmosets and suckling mice.

II.L. Screening for Anti-Viral Agents for HCV

The availability of cell culture and animal model systems for HCV also makes possible screening for anti-viral agents which inhibit HCV replication, and particularly for those agents which preferentially allow cell growth and multiplication while inhibiting viral replication. These screening methods are known by those of skill in the art. Generally, the anti-viral agents are tested at a variety of concentrations, for their effect on preventing viral replication in cell culture systems which support viral replication, and then for an inhibition of infectivity or of viral pathogenicity (and a low level of toxicity) in an animal model system.

The methods and compositions provided herein for detecting HCV antigens and HCV polynucleotides are useful for screening of anti-viral agents in that they provide an alternative, and perhaps more sensitive means, for detecting the agent's effect on viral replication than the cell plaque assay or $ID_{50}$ assay. For example, the HCV-polynucleotide probes described herein may be used to quantitate the amount of viral nucleic acid produced in a cell culture. This could be accomplished, for example, by hybridization or competition hybridization of the infected cell nucleic acids with a labeled HCV-polynucleotide probe. For example, also, anti-HCV antibodies may be used to identify and quantitate HCV antigen(s) in the cell culture utilizing the immunoassays described herein. In addition, since it may be desirable to quantitate HCV antigens in the infected cell culture by a competition assay, the polypeptides encoded within the HCV cDNAs described herein are useful in these competition assays. Generally, a recombinant HCV polypeptide derived from the HCV cDNA would be labeled, and the inhibition of binding of this labeled polypeptide to an HCV polypeptide due to the antigen produced in the cell culture system would be monitored. Moreover, these techniques are particularly useful in cases where the HCV may be able to replicate in a cell line without causing cell death.

The anti-viral agents which may be tested for efficacy by these methods are known in the art, and include, for example, those which interact with virion components and/or cellular components which are necessary for the binding and/or replication of the virus. Typical anti-viral agents may include, for example, inhibitors of virion polymerase and/or protease(s) necessary for cleavage of the precursor polypeptides. Other anti-viral agents may include those which act with nucleic acids to prevent viral replication, for example, anti-sense polynucleotides, etc.

Antisense polynucleotides molecules are comprised of a complementary nucleotide sequence which allows them to hybridize specifically to designated regions of genomes or RNAs. Antisense polynucleotides may include, for example, molecules that will block protein translation by binding to mRNA, or may be molecules which prevent replication of viral RNA by transcriptase. They may also include molecules which carry agents (non-covalently attached or covalently bound) which cause the viral RNA to be inactive by causing, for example, scissions in the viral RNA. They may also bind to cellular polynucleotides which enhance and/or are required for viral infectivity, replicative ability, or chronicity. Antisense molecules which are to hybridize to HCV derived RNAs may be designed based upon the sequence information of the HCV cDNAs provided herein. The antiviral agents based upon anti-sense polynucleotides for HCV may be designed to bind with high specificity, to be of increased solubility, to be stable, and to have low toxicity. Hence, they may be delivered in specialized systems, for example, liposomes, or by gene therapy. In addition, they may include analogs, attached proteins, substituted or altered bonding between bases, etc.

Other types of drugs may be based upon polynucleotides which "mimic" important control regions of the HCV genome, and which may be therapeutic due to their interactions with key components of the system responsible for viral infectivity or replication.

II.M. Preparation of Attenuated Strains of HCV

In addition to the above, utilizing the tissue culture systems and/or animal model systems, it may be possible to isolate attenuated strains of HCV. These strains would be suitable for vaccines, or for the isolation of viral antigens. Attenuated strains are isolatable after multiple passages in cell culture and/or an animal model. Detection of an attenuated strain in an infected cell or individual is achievable by techniques known in the art, and could include, for example, the use of antibodies to one or more epitopes encoded in HCV as a probe or the use of a polynucleotide containing an HCV sequence of at least about 8 nucleotides as a probe. Alternatively, or in addition, an attenuated strain may be constructed utilizing the genomic information of HCV provided herein, and utilizing recombinant techniques. Generally, one would attempt to delete a region of the genome encoding, for example, a polypeptide related to pathogenicity, but which allows viral replication. In addition, the genome construction would allow the expression of an epitope which gives rise to neutralizing antibodies for HCV. The altered genome could then be utilized to transform cells which allow HCV replication, and the cells grown under conditions to allow viral replication. Attenuated HCV strains are useful not only for vaccine purposes, but also as sources for the commercial production of viral antigens, since the processing of these viruses would require less stringent protection measures for the employees involved in viral production and/or the production of viral products.

III. General Methods

The general techniques used in extracting the genome from a virus, preparing and probing a cDNA library, sequencing clones, constructing expression vectors, transforming cells, performing immunological assays such as radioimmunoassays and ELISA assays, for growing cells in culture, and the like are known in the art and laboratory manuals are available describing these techniques. However, as a general guide, the following sets forth some sources currently available for such procedures, and for materials useful in carrying them out.

III.A. Hosts and Expression Control Sequences

Both prokaryotic and eukaryotic host cells may be used for expression of desired coding sequences when appropriate control sequences which are compatible with the designated host are used. Among prokaryotic hosts, *E. coli* is most frequently used. Expression control sequences for prokaryotes include promoters, optionally containing operator portions, and ribosome binding sites. Transfer vectors compatible with prokaryotic hosts are commonly derived from, for example, pBR322, a plasmid containing operons conferring ampicillin and tetracycline resistance, and the various pUC vectors, which also contain sequences conferring antibiotic resistance markers. These markers may be used to obtain successful transformants by selection. Commonly used prokaryotic control sequences include the B-lactamase (penicillinase) and lactose promoter systems (Chang et al. (1977)), the tryptophan (trp) promoter system (Goeddel et al. (1980)) and the lambda-derived $P_L$ promoter and N gene ribosome binding site (Shimatake et al. (1981)) and the hybrid tac promoter (De Boer et al. (1983)) derived from sequences of the trp and lac UV5 promoters. The foregoing systems are particularly compatible with *E. coli*; if desired, other prokaryotic hosts such as strains of Bacillus or Pseudomonas may be used, with corresponding control sequences.

Eukaryotic hosts include yeast and mammalian cells in culture systems. *Saccharomyces cerevisiae* and *Saccharomyces carlsbergensis* are the most commonly used yeast hosts, and are convenient fungal hosts. Yeast compatible vectors carry markers which permit selection of successful transformants by conferring prototrophy to auxotrophic mutants or resistance to heavy metals on wild-type strains. Yeast compatible vectors may employ the 2m origin of replication (Broach et al. (1983)), the combination of CEN3 and ARS1 or other means for assuring replication, such as sequences which will result in incorporation of an appropriate fragment into the host cell genome. Control sequences for yeast vectors are known in the art and include promoters for the synthesis of glycolytic enzymes (Hess et al. (1968); Holland et al. (1978)), including the promoter for 3 phosphoglycerate kinase (Hitzeman (1980)). Terminators may also be included, such as those derived from the enolase gene (Holland (1981)). Particularly useful control systems are those which comprise the glyceraldehyde-3 phosphate dehydrogenase (GAPDH) promoter or alcohol dehydrogenase (ADH) regulatable promoter, terminators also derived from GAPDH, and if secretion is desired, leader sequence from yeast α-factor. In addition, the transcriptional regulatory region and the transcriptional initiation region which are operably linked may be such that they are not naturally associated in the wild-type organism. These systems are described in detail in EPO 120,551, published Oct. 3, 1984; EPO 116,201, published Aug. 22, 1984; and EPO 164,556, published Dec. 18, 1985, all of which are assigned to the herein assignee, and are hereby incorporated herein by reference.

Mammalian cell lines available as hosts for expression are known in the art and include many immortalized cell lines available from the American Type Culture Collection (ATCC), including HeLa cells, Chinese hamster ovary (CHO) cells, baby hamster kidney (BHK) cells, and a number of other cell lines. Suitable promoters for mammalian cells are also known in the art and include viral promoters such as that from Simian Virus 40 (SV40) (Fiers (1978)), Rous sarcoma virus (RSV), adenovirus (ADV), and bovine papilloma virus (BPV). Mammalian cells may also require terminator sequences and poly A addition sequences; enhancer sequences which increase expression may also be included, and sequences which cause amplification of the gene may also be desirable. These sequences are known in the art.

Vectors suitable for replication in mammalian cells are known in the art, and may include viral replicons, or sequences which insure integration of the appropriate sequences encoding NANBV epitopes into the host genome.

A vector which is used to express foreign DNA, and which may be used in vaccine preparation is Vaccinia virus. In this case the heterologous DNA is inserted into the Vaccinia genome. Techniques for the insertion of foreign DNA into the vaccinia virus genome are known in the art, and utilize, for example, homologous recombination. The insertion of the heterologous DNA is generally into a gene which is non-essential in nature, for example, the thymidine kinase gene (tk), which also provides a selectable marker. Plasmid vectors that greatly facilitate the construction of recombinant viruses have been described (see, for example, Mackett et al. (1984), Chakrabarti et al. (1985); Moss (1987)). Expression of the HCV polypeptide then occurs in cells or individuals which are immunized with the live recombinant vaccinia virus.

The segment of HCV cDNA which is inserted into a Vaccinia vector may be derived from the "x" region of the HCV genome (see FIG. 69); for example, it may encode a polypeptide comprised of amino acid numbers 406–661. The polypeptide encoding sequence may be attached to a leader sequence. The leader sequence may be that for tissue plasminogen activator (tPA), or from another source, e.g., that for β-globin. The heterologous polynucleotide may be inserted into a vaccinia vector which is a modified version of pSC11, due to the addition of a polylinker sequence which contains a cloning site.

The segment of HCV cDNA which is inserted into the Vaccinia vector may also be derived from the "x" region of the HCV genome, but it may encode a larger polypeptide, i.e., one comprised of amino acid numbers 347–906. The polypeptide encoding sequence, which may or may not be attached to an upstream heterologous leader sequence, may be inserted into the modified pSC11 vaccinia vector described above.

In order to detect whether or not the HCV polypeptide is expressed from the vaccinia vector, BSC 1 cells may be infected with the recombinant vector and grown on microscope slides under conditions which allow expression. The cells may then be acetone-fixed, and immunofluorescence assays performed using serum which is known to contain anti-HCV antibodies to a polypeptide(s) encoded in the region of the HCV genome from which the HCV segment in the recombinant expression vector was derived.

Other systems for expression of eukaryotic or viral genomes include insect cells and vectors suitable for use in these cells. These systems are known in the art, and include, for example, insect expression transfer vectors derived from the baculovirus *Autographa californica* nuclear polyhedrosis virus (AcNPV), which is a helper-independent, viral expression vector. Expression vectors derived from this system usually use the strong viral polyhedron gene promoter to drive expression of heterologous genes. Currently the most commonly used transfer vector for introducing foreign genes into AcNPV is pAc373 (FIG. 70). Many other vectors, known to those of skill in the art, have also been designed for improved expression. These include, for example, pVL985 (which alters the polyhedron start codon from ATG to ATT, and which introduces a BamHI cloning site 32 basepairs downstream from the ATT; See Luckow and Summers (1989)). AcNPV transfer vectors for high level expression of nonfused foreign proteins are shown in FIG. 70. In the figure, the numbers shown refer to positions within the native gene, where the A of the ATG codon is +1. FIG. 70 also shows a restriction endonuclease map of the transfer vector pAc373. The map shows that a unique BamHI site is located following position 8 with respect to the translation initiation codon ATG of the polyhedron gene. There are no cleavage sites for SmaI, PstI, BglII, XbaI or SstI. Good expression of nonfused foreign proteins usually requires foreign genes that ideally have a short leader sequence containing suitable translation initiation signals preceding an ATG start signal. The plasmid also contains the polyhedron polyadenylation signal and the ampicillin-resistance (amp) gene and origin of replication for selection and propagation in *E. coli.*

Methods for the introduction of heterologous DNA into the desired site in the baculovirus virus are known in the art. (See Summer and Smith, Texas Agricultural Experiment Station Bulletin No.1555; Ju et al. (1987); Smith et al. (1983); and Luckow and Summers (1989)). For example, the insertion can be into a gene such as the polyhedron gene, by homologous recombination; insertion can also be into a restriction enzyme site engineered into the desired baculovirus gene. The inserted sequences may be those which encode all or varying segments of the polyprotein, or other orfs which encode viral polypeptides. For example, the insert could encode the following numbers of amino acid segments from the polyprotein: amino acids 1–1078; amino acids 332–662; amino acids 406–662; amino acids 156–328, and amino acids 199–328.

The signals for posttranslational modifications, such as signal peptide cleavage, proteolytic cleavage, and phosphorylation, appear to be recognized by insect cells. The signals required for secretion and nuclear accumulation also appear to be conserved between the invertebrate cells and vertebrate cells. Examples of the signal sequences from vertebrate cells which are effective in invertebrate cells are known in the art, for example, the human interleukin 2 signal (IL2s) which is a signal for transport out of the cell, is recognized and properly removed in insect cells.

III.B. Transformations

Transformation may be by any known method for introducing polynucleotides into a host cell, including, for example packaging the polynucleotide in a virus and transducing a host cell with the virus, and by direct uptake of the polynucleotide. The transformation procedure used depends upon the host to be transformed. For example, transformation of the E. coli host cells with λgt11 containing BB-NANBV sequences is discussed in the Example section, infra. Bacterial transformation by direct uptake generally employs treatment with calcium or rubidium chloride (Cohen (1972); Maniatis (1982)). Yeast transformation by direct uptake may be carried out using the method of Hinnen et al. (1978). Mammalian transformations by direct uptake may be conducted using the calcium phosphate precipitation method of Graham and Van der Eb (1978), or the various known modifications thereof. Other methods for the introduction of recombinant polynucleotides into cells, particularly into mammalian cells, which are known in the art include dextran-mediated transfection, calcium phosphate mediated transfection, polybrene mediated transfection, protoplast fusion, electroporation, encapsulation of the polynucleotide(s) in liposomes, and direct microinjection of the polynucleotides into nuclei.

III.C. Vector Construction

Vector construction employs techniques which are known in the art. Site-specific DNA cleavage is performed by treating with suitable restriction enzymes under conditions which generally are specified by the manufacturer of these commercially available enzymes. In general, about 1 mg of plasmid or DNA sequence is cleaved by 1 unit of enzyme in about 20 mL buffer solution by incubation of 1–2 hr at 37° C. After incubation with the restriction enzyme, protein is removed by phenol/chloroform extraction and the DNA recovered by precipitation with ethanol. The cleaved fragments may be separated using polyacrylamide or agarose gel electrophoresis techniques, according to the general procedures found in Methods in Enzymology (1980) 65:499–560.

Sticky ended cleavage fragments may be blunt ended using E. coli DNA polymerase I (Klenow) in the presence of the appropriate deoxynucleotide triphosphates (dNTPs) present in the mixture. Treatment with S1 nuclease may also be used, resulting in the hydrolysis of any single stranded DNA portions.

Ligations are carried out using standard buffer and temperature conditions using T4 DNA ligase and ATP; sticky end ligations require less ATP and less ligase than blunt end ligations. When vector fragments are used as part of a ligation mixture, the vector fragment is often treated with bacterial alkaline phosphatase (BAP) or calf intestinal alkaline phosphatase to remove the 5'-phosphate and thus prevent religation of the vector; alternatively, restriction enzyme digestion of unwanted fragments can be used to prevent ligation.

Ligation mixtures are transformed into suitable cloning hosts, such as E. coli, and successful transformants selected by, for example, antibiotic resistance, and screened for the correct construction.

III.D. Construction of Desired DNA Sequences

Synthetic oligonucleotides may be prepared using an automated oligonucleotide synthesizer as described by Warner (1984). If desired the synthetic strands may be labeled with $^{32}P$ by treatment with polynucleotide kinase in the presence of $^{32}P$-ATP, using standard conditions for the reaction.

DNA sequences, including those isolated from cDNA libraries, may be modified by known techniques, including, for example site directed mutagenesis, as described by Zoller (1982). Briefly, the DNA to be modified is packaged into phage as a single stranded sequence, and converted to a double stranded DNA with DNA polymerase using, as a primer, a synthetic oligonucleotide complementary to the portion of the DNA to be modified, and having the desired modification included in its own sequence. The resulting double stranded DNA is transformed into a phage supporting host bacterium. Cultures of the transformed bacteria, which contain replications of each strand of the phage, are plated in agar to obtain plaques. Theoretically, 50% of the new plaques contain phage having the mutated sequence, and the remaining 50% have the original sequence. Replicates of the plaques are hybridized to labeled synthetic probe at temperatures and conditions which permit hybridization with the correct strand, but not with the unmodified sequence. The sequences which have been identified by hybridization are recovered and cloned.

III.E. Hybridization with Probe

DNA libraries may be probed using the procedure of Grunstein and Hogness (1975). Briefly, in this procedure, the DNA to be probed is immobilized on nitrocellulose filters, denatured, and prehybridized with a buffer containing 0–50% formamide, 0.75 M NaCl, 75 mM Na citrate, 0.02% (wt/v) each of bovine serum albumin, polyvinyl pyrollidone, and Ficoll, 50 mM Na Phosphate (pH 6.5), 0.1% SDS, and 100 mg/mL carrier denatured DNA. The percentage of formamide in the buffer, as well as the time and temperature conditions of the prehybridization and subsequent hybridization steps depends on the stringency required. Oligomeric probes which require lower stringency conditions are generally used with low percentages of formamide, lower temperatures, and longer hybridization times. Probes containing more than 30 or 40 nucleotides such as those derived from cDNA or genomic sequences generally employ higher temperatures, e.g., about 40–42° C., and a high percentage, e.g., 50%, formamide. Following prehybridization, 5'-$^{32}P$-labeled oligonucleotide probe is added to the buffer, and the filters are incubated in this mixture under hybridization conditions. After washing, the treated filters are subjected to autoradiography to show the location of the hybridized probe; DNA in corresponding locations on the original agar plates is used as the source of the desired DNA.

III.F. Verification of Construction and Sequencing

For routine vector constructions, ligation mixtures are transformed into E. coli strain HB101 or other suitable host, and successful transformants selected by antibiotic resistance or other markers. Plasmids from the transformants are then prepared according to the method of Clewell et al. (1969), usually following chloramphenicol amplification (Clewell (1972)). The DNA is isolated and analyzed, usually by restriction enzyme analysis and/or sequencing. Sequencing may be by the dideoxy method of Sanger et al. (1977) as further described by Messing et al. (1981), or by the method of Maxam et al. (1980). Problems with band compression, which are sometimes observed in GC rich regions, were overcome by use of T-deazoguanosine according to Barr et al. (1986).

III.G. Enzyme Linked Immunosorbent Assay

The enzyme-linked immunosorbent assay (ELISA) can be used to measure either antigen or antibody concentrations. This method depends upon conjugation of an enzyme to either an antigen or an antibody, and uses the bound enzyme activity as a quantitative label. To measure antibody, the known antigen is fixed to a solid phase (e.g., a microplate or plastic cup), incubated with test serum dilutions, washed, incubated with anti-immunoglobulin labeled with an enzyme, and washed again. Enzymes suitable for labeling are known in the art, and include, for example, horseradish peroxidase. Enzyme activity bound to the solid phase is measured by adding the specific substrate, and determining product formation or substrate utilization calorimetrically. The enzyme activity bound is a direct function of the amount of antibody bound.

To measure antigen, a known specific antibody is fixed to the solid phase, the test material containing antigen is added, after an incubation the solid phase is washed, and a second enzyme-labeled antibody is added. After washing, substrate is added, and enzyme activity is estimated calorimetrically, and related to antigen concentration.

IV. Examples

Described below are examples of the present invention which are provided only for illustrative purposes, and not to limit the scope of the present invention. In light of the present disclosure, numerous embodiments within the scope of the claims will be apparent to those of ordinary skill in the art. The procedures set forth, for example, in Sections IV.A. may, if desired, be repeated but need not be, as techniques are available for construction of the desired nucleotide sequences based on the information provided by the invention. Expression is exemplified in *E. coli*; however, other systems are available as set forth more fully in Section III.A. Additional epitopes derived from the genomic structure may also be produced, and used to generate antibodies as set forth below.

IV.A. Preparation Isolation and Sequencing of HCV cDNA

IV.A.1. Preparation of HCV cDNA

The source of NANB agent was a plasma pool derived from a chimpanzee with chronic NANBH. The chimpanzee had been experimentally infected with blood from another chimpanzee with chronic NANBH resulting from infection with HCV in a contaminated batch of factor 8 concentrate derived from pooled human sera. The chimpanzee plasma pool was made by combining many individual plasma samples containing high levels of alanine aminotransferase activity; this activity results from hepatic injury due to the HCV infection. Since 1 mL of a $10^{-6}$ dilution of this pooled serum given i.v. caused NANBH in another chimpanzee, its CID was at least $10^6$/mL, i.e., it had a high infectious virus titer.

A cDNA library from the high titer plasma pool was generated as follows. First, viral particles were isolated from the plasma; a 90 mL aliquot was diluted with 310 mL of a solution containing 50 mM Tris-HCl, pH 8.0, 1 mM EDTA, 100 mM NaCl. Debris was removed by centrifugation for 20 min at 15,000×g at 20° C. Viral particles in the resulting supernatant were then pelleted by centrifugation in a Beckman SW28 rotor at 28,000 rpm for 5 hours at 20° C. To release the viral genome, the particles were disrupted by suspending the pellets in 15 mL solution containing 1% sodium dodecyl sulfate (SDS), 10 mM EDTA, 10 mM Tris-HCl, pH 7.5, also containing 2 mg/mL proteinase k, followed by incubation at 45° C. for 90 min. Nucleic acids were isolated by adding 0.8 mg MS2 bacteriophage RNA as carrier, and extracting the mixture four times with a 1:1 mixture of phenol:chloroform (phenol saturated with 0.05 M Tris-HCl, pH 7.5, 0.1% (v/v) b-mercaptoethanol, 0.1% (w/v) hydroxyquinolone, followed by extraction twice with chloroform. The aqueous phase was concentrated with 1-butanol prior to precipitation with 2.5 volumes absolute ethanol overnight at −20° C. Nucleic acid was recovered by centrifugation in a Beckman SW41 rotor at 40,000 rpm for 90 min at 4° C., and dissolved in water that had been treated with 0.05% (v/v) diethylpyrocarbonate and autoclaved.

Nucleic acid obtained by the above procedure (<2 mg) was denatured with 17.5 mM $CH_3HgOH$; cDNA was synthesized using this denatured nucleic acid as template, and was cloned into the EcoRI site of phage λgt11 using methods described by Huynh (1985), except that random primers replaced oligo(dT) 12–18 during the synthesis of the first cDNA strand by reverse transcriptase (Taylor et al. (1976)). The resulting double stranded cDNAs were fractionated according to size on a Sepharose® CL-4B column; eluted material of approximate mean size 400, 300, 200, and 100 base-pairs were pooled into cDNA pools 1, 2, 3, and 4, respectively. The λgt11 cDNA library was generated from the cDNA in pool 3.

The λgt11 cDNA library generated from pool 3 was screened for epitopes that could bind specifically with serum derived from a patient who had previously experienced NANBH. About $10^6$ phage were screened with patient sera using the methods of Huynh et al. (1985), except that bound human antibody was detected with sheep anti-human Ig antisera that had been radio-labeled with $^{125}I$. Five positive phages were identified and purified. The five positive phages were then tested for specificity of binding to sera from 8 different humans previously infected with the NANBH agent, using the same method. Four of the phage encoded a polypeptide that reacted immunologically with only one human serum, i.e., the one that was used for primary screening of the phage library. The fifth phage (5-1-1) encoded a polypeptide that reacted immunologically with 5 of 8 of the sera tested. Moreover, this polypeptide did not react immunologically with sera from 7 normal blood donors. Therefore, it appears that clone 5-1-1 encodes a polypeptide which is specifically recognized immunologically by sera from NANB patients.

IV.A.2. Sequences of the HCV cDNA in Recombinant Phage 5-1-1, and of the Polypeptide Encoded Within the Sequence.

The cDNA in recombinant phage 5-1-1 was sequenced by the method of Sanger et al. (1977). Essentially, the cDNA was excised with EcoRI, isolated by size fractionation using gel electrophoresis. The EcoRI restriction fragments were subcloned into the M13 vectors, mp18 and mp19 (Messing (1983)) and sequenced using the dideoxy chain termination method of Sanger et al. (1977). The sequence obtained is shown in FIG. 1.

The polypeptide encoded in FIG. 1 that is encoded in the HCV cDNA is in the same translational frame as the N-terminal b-galactosidase moiety to which it is fused. As shown in Section IV.A., the translational open reading frame (ORF) of 5-1- 1 encodes epitope(s) specifically recognized by sera from patients and chimpanzees with NANBH infections.

IV.A.3. Isolation of Overlapping HCV cDNA to cDNA in Clone 5-1-1.

Overlapping HCV cDNA to the cDNA in clone 5-1-1 was obtained by screening the same λgt11 library, created as described in Section IV.A.1., with a synthetic polynucleotide derived from the sequence of the HCV cDNA in clones 5-1-1, as shown in FIG. 1. The sequence of the polynucleotide used for screening was:

5'-TCC CTT GCT CGA TGT ACG GTA AGT GCT GAG AGC
ACT CTT CCA TCT CAT CGA ACT CTC GGT AGA GGA
CTT CCC TGT CAG GT-3'          (SEQ ID NO:178).

The λgt11 library was screened with this probe, using the method described in Huynh (1985). Approximately 1 in 50,000 clones hybridized with the probe. Three clones which contained cDNAs which hybridized with the synthetic probe have been numbered 81, 1-2, and 91.

IV.A.4. Nucleotide Sequences of Overlapping HCV cDNAs to cDNA in Clone 5-1-1.

The nucleotide sequences of the three cDNAs in clones 81, 1-2, and 91 were determined essentially as in Section IV.A.2. The sequences of these clones relative to the HCV cDNA sequence in phage 5-1-1 is shown in FIG. 2, which shows the strand encoding the detected HCV epitope, and where the homologies in the nucleotide sequences are indicated by vertical lines between the sequences.

The sequences of the cloned HCV cDNAs are highly homologous in the overlapping regions (see FIG. 2). However, there are differences in two regions. Nucleotide 67 in clone 1-2 is a thymidine, whereas the other three clones contain a cytidine residue in this position. It should be noted, however, that the same amino acid is encoded when either C or T occupies this position.

The second difference is that clone 5-1-1 contains 28 base pairs which are not present in the other three clones. These base pairs occur at the start of the cDNA sequence in 5-1-1, and are indicated by small letters. The 28 bp region is probably a terminal artifact in clone 5-1-1 which enhances its antigenicity.

The sequences of small letters in the nucleotide sequence of clones 81 and 91 simply indicate that these sequences have not been found in other cDNAs because cDNAs overlapping these regions were not yet isolated.

A composite HCV cDNA sequence derived from overlapping cDNAs in clones 5-1-1, 81, 1-2 and 91 is shown in FIG. 3. However, in this figure the unique 28 base pairs of clone 5-1-1 are omitted. The figure also shows the sequence of the polypeptide encoded within the ORF of the composite HCV cDNA.

IV.A.5. Isolation of Overlapping HCV cDNAs to cDNA in Clone 81.

The isolation of HCV cDNA sequences upstream of, and which overlap those in clone 81 cDNA was accomplished as follows. The λgt11 cDNA library prepared as described in Section IV.A.1. was screened by hybridization with a synthetic polynucleotide probe which was homologous to a 5'-terminal sequence of clone 81. The sequence of clone 81 is presented in FIG. 4. The sequence of the synthetic polynucleotide used for screening was:

5' CTG TCA GGT ATG ATT GCC GGC
   TTC CCG GAC 3'          (SEQ ID NO:179).

The methods were essentially as described in Huynh (1985), except that the library filters were given two washes under stringent conditions, i.e., the washes were in 5' SSC, 0.1% SDS at 55° C. for 30 minutes each. Approximately 1 in 50,000 clones hybridized with the probe. A positive recombinant phage which contained cDNA which hybridized with the sequence was isolated and purified. This phage has been numbered clone 36.

Downstream cDNA sequences, which overlaps the carboxyl-end sequences in clone 81 cDNA were isolated using a procedure similar to that for the isolation of upstream cDNA sequences, except that a synthetic oligonucleotide probe was prepared which is homologous to a 3' terminal sequence of clone 81. The sequence of the synthetic polynucleotide used for screening was:

5' TTT GGC TAG TGG TTA GTG GGC
   TGG TGA CAG 3'          (SEQ ID NO:180).

A positive recombinant phage, which contained cDNA which hybridized with this latter sequence was isolated and purified, and has been numbered clone 32.

IV.A.6. Nucleotide Sequence of HCV cDNA in Clone 36.

The nucleotide sequence of the cDNA in clone 36 was determined essentially as described in Section IV.A.2. The double-stranded sequence of this cDNA, its region of overlap with the HCV cDNA in clone 81, and the polypeptide encoded by the ORF are shown in FIG. 5.

The ORF in clone 36 is in the same translational frame as the HCV antigen encoded in clone 81. Thus, in combination, the ORFs in clones 36 and 81 encode a polypeptide that represents part of a large HCV antigen. The sequence of this putative HCV polypeptide and the double stranded DNA sequence encoding it, which is derived from the combined ORFs of the HCV cDNAs of clones 36 and 81, is shown in FIG. 6.

IV.A.7 Nucleotide Sequences of HCV cDNA in Clone 32

The nucleotide sequence of the cDNA in clone 32 was determined essentially as was that described in Section IV.A.2 for the sequence of clone 5-1-1. The sequence data indicated that the cDNA in clone 32 recombinant phage was derived from two different sources. One fragment of the cDNA was comprised of 418 nucleotides derived from the HCV genome; the other fragment was comprised of 172 nucleotides derived from the bacteriophage MS2 genome, which had been used as a carrier during the preparation of the λgt11 plasma cDNA library.

The sequence of the cDNA in clone 32 corresponding to that of the HCV genome is shown in FIG. 7. The region of the sequences that overlaps that of clone 81, and the polypeptide encoded by the ORF are also indicated in the figure. This sequence contains one continuous ORF that is in the same translational frame as the HCV antigen encoded by clone 81.

IV.A.8 Isolation of Overlapping HCV cDNA to cDNA in Clone 36

The isolation of HCV cDNA sequences upstream of, and which overlap those in clone 36 cDNA was accomplished as described in Section IV.A.5, for those which overlap clone 81 cDNA, except that the synthetic polynucleotide was based on the 5'-region of clone 36. The sequence of the synthetic polynucleotide used for screening was:

5' AAG CCA CCG TGT GCG CTA GCG
   CTC AAG CCC 3'          (SEQ ID NO:181).

Approximately 1 in 50,000 clones hybridized with the probe. The isolated, purified clone of recombinant phage which contained cDNA which hybridized to this sequence was named clone 35.

IV.A.9 Nucleotide Sequence of HCV cDNA in Clone 35

The nucleotide sequence of the cDNA in clone 35 was determined essentially as described in Section IV.A.2. The sequence, its region of overlap with that of the cDNA in clone 36, and the putative polypeptide encoded therein, are shown in FIG. 8.

Clone 35 apparently contains a single, continuous ORF that encodes a polypeptide in the same translational frame as that encoded by clone 36, clone 81, and clone 32. FIG. 9 shows the sequence of the long continuous ORF that extends through clones 35, 36, 81, and 32, along with the putative HCV polypeptide encoded therein. This combined sequence has been confirmed using other independent cDNA clones derived from the same λgt11 cDNA library.

IV.A.10. Isolation of Overlapping HCV cDNA to cDNA in Clone 35

The isolation of HCV cDNA sequences upstream of, and which overlap those in clone 35 cDNA was accomplished as described in Section IV.A.8, for those which overlap clone 36 cDNA, except that the synthetic polynucleotide was based on the 5'-region of clone 35. The sequence of the synthetic polynucleotide used for screening was:

5' CAG GAT GCT GTC TCC CGC ACT
  CAA CGT 3'                            (SEQ ID NO:182).

Approximately 1 in 50,000 clones hybridized with the probe. The isolated, purified clone of recombinant phage which contained cDNA which hybridized to this sequence was named clone 37b.

IV.A.11. Nucleotide Sequence of HCV in Clone 37b

The nucleotide sequence of the cDNA in clone 37b was determined essentially as described in Section IV.A.2. The sequence, its region of overlap with that of the cDNA in clone 35, and the putative polypeptide encoded therein, are shown in FIG. 10.

The 5'-terminal nucleotide of clone 35 is a T, whereas the corresponding nucleotide in clone 37b is an A. The cDNAs from three other independent clones which were isolated during the procedure in which clone 37b was isolated, described in Section IV.A.10, have also been sequenced. The cDNAs from these clones also contain an A in this position. Thus, the 5'-terminal T in clone 35 may be an artifact of the cloning procedure. It is known that artifacts often arise at the 5'-termini of cDNA molecules.

Clone 37b apparently contains one continuous ORF which encodes a polypeptide which is a continuation of the polypeptide encoded in the ORF which extends through the overlapping clones 35, 36, 81 and 32.

IV.A.12. Isolation of Overlapping HCV cDNA to cDNA in Clone 32

The isolation of HCV cDNA sequences downstream of clone 32 was accomplished as follows. First, clone cla was isolated utilizing a synthetic hybridization probe which was based on the nucleotide sequence of the HCV cDNA sequence in clone 32. The method was essentially that described in Section IV.A.5, except that the sequence of the synthetic probe was:

5' AGT GCA GTG GAT GAA CCG GCT
  GAT AGC CTT 3'.                       (SEQ ID NO:183).

Utilizing the nucleotide sequence from clone cla, another synthetic nucleotide was synthesized which had the sequence:

5' TCC TGA GGC GAC TGC ACC AGT
  GGA TAA GCT 3'                        (SEQ ID NO:184).

Screening of the λgt11 library using the clone cla derived sequence as probe yielded approximately 1 in 50,000 positive colonies. An isolated, purified clone which hybridized with this probe was named clone 33b.

IV.A.13. Nucleotide Sequence of HCV cDNA in Clone 33b

The nucleotide sequence of the cDNA in clone 33b was determined essentially as described in Section IV.A.2. The sequence, its region of overlap with that of the cDNA in clone 32, and the putative polypeptide encoded therein, are shown in FIG. 11.

Clone 33b apparently contains one continuous ORF which is an extension of the ORFs in overlapping clones 37b, 35, 36, 81 and 32. The polypeptide encoded in clone 33b is in the same translational frame as that encoded in the extended ORF of these overlapping clones.

IV.A.14. Isolation of Overlapping HCV cDNAs to cDNA Clone 37b and to cDNA in Clone 33b In order to isolate HCV cDNAs which overlap the cDNAs in clone 37b and in clone 33b, the following synthetic oligonucleotide probes, which were derived from the cDNAs in those clones, were used to screen the λgt11 library, using essentially the method described in Section IV.A.3. The probes used were:

5' CAG GAT GCT GTC TCC CGC ACT
  CAA CGT C 3'                          (SEQ ID NO:185)

and

5' TCC TGA GGC GAC TGC ACC AGT
  GGA TAA GCT 3'                        (SEQ ID NO:186)

to detect colonies containing HCV cDNA sequences which overlap those in clones 37b and 33b, respectively. Approximately 1 in 50,000 colonies were detected with each probe. A clone which contained cDNA which was upstream of, and which overlapped the cDNA in clone 37b, was named clone 40b. A clone which contained cDNA which was downstream of, and which overlapped the cDNA in clone 33b was named clone 25c.

IV.A.15 Nucleotide Sequences of HCV cDNA in clone 40b and in clone 25c

The nucleotide sequences of the cDNAs in clone 40b and in clone 25c were determined essentially as described in Section IV.A.2. The sequences of 40b and 25c, their regions of overlap with the cDNAs in clones 37b and 33b, and the putative polypeptides encoded therein, are shown in FIG. 12 (clone 40b) and FIG. 13 (clone 25c).

The 5'-terminal nucleotide of clone 40b is a G. However, the cDNAs from five other independent clones which were isolated during the procedure in which clone 40b was isolated, described in Section IV.A.14, have also been sequenced. The cDNAs from these clones also contain a T in this position. Thus, the G may represent a cloning artifact (see the discussion in Section IV.A.11).

The 5'-terminus of clone 25c is ACT, but the sequence of this region in clone cla (sequence not shown), and in clone 33b is TCA. This difference may also represent a cloning artifact, as may the 28 extra 5'-terminal nucleotides in clone 5-1-1.

Clones 40b and 25c each apparently contain an ORF which is an extension of the continuous ORF in the previously sequenced clones. The nucleotide sequence of the ORF extending through clones 40b, 37b, 35, 36, 81, 32, 33b, and 25c, and the amino acid sequence of the putative polypeptide encoded therein, are shown in FIG. 14. In the figure, the potential artifacts have been omitted from the sequence, and instead, the corresponding sequences in non-5'-terminal regions of multiple overlapping clones are shown.

IV.A.16. Preparation of a Composite HCV cDNA from the cDNAs in Clones 36, 81, and 32

The composite HCV cDNA, C100, was constructed as follows. First the cDNAs from the clones 36, 81, and 32 were excised with EcoRI. The EcoRI fragment of cDNA from each clone was cloned individually into the EcoRI site of the vector pGEM3-blue (Promega Biotec). The resulting recombinant vectors which contained the cDNAs from clones 36, 81, and 32 were named pGEM3-blue/36, pGEM3-blue/81, and pGEM3-blue/32, respectively. The appropriately oriented recombinant of pGEM3-blue/81 was digested with NaeI and NarI, and the large (~2850 bp) fragment was purified and ligated with the small (~570 bp) NaeI/NarI purified restriction fragment from pGEM3-blue/36. This composite of the cDNAs from clones 36 and 81 was used to generate another pGEM3-blue vector containing the continuous HCV ORF contained within the overlapping cDNA within these clones. This new plasmid was then digested with PvuII and EcoRI to release a fragment of approximately 680 bp, which was then ligated with the small (580 bp) PvuII/EcoRI fragment isolated from the appropriately oriented pGEM3-blue/32 plasmid, and the composite cDNA from clones 36, 81, and 32 was ligated into the EcoRI linearized vector pSODcf1, which is described in Section IV.B.1, and which was used to express clone 5-1-1 in bacteria. Recombinants containing the ~1270 bp EcoRI fragment of composite HCV cDNA (C100) were selected, and the cDNA from the plasmids was excised with EcoRI and purified.

IV.A.17. Isolation and Nucleotide Sequences of HCV cDNAs in Clones 14i, 11b, 7f, 7e, 8h, 33c, 14c, 8f, 33f, 33g, and 39c The HCV cDNAs in clones 14i, 11b, 7f, 7e, 8h, 33c, 14c, 8f, 33f, 33g, and 39c were isolated by the technique of isolating overlapping cDNA fragments from the λgt11 library of HCV cDNAs described in Section IV.A.1. The technique used was essentially as described in Section IV.A.3., except that the probes used were designed from the nucleotide sequence of the last isolated clones from the 5' and the 3' end of the combined HCV sequences. The frequency of clones which hybridized with the probes described below was approximately 1 in 50,000 in each case.

The nucleotide sequences of the HCV cDNAs in clones 14i, 7f, 7e, 8h, 33c, 14c, 8f, 33f, 33g, and 39c were determined essentially as described in Section IV.A.2., except that the cDNA excised from these phages were substituted for the cDNA isolated from clone 5-1-1.

Clone 33c was isolated using a hybridization probe based on the sequence of nucleotides in clone 40b. The nucleotide sequence of clone 40b is presented in FIG. 12. The nucleotide sequence of the probe used to isolate 33c was:

5' ATC AGG ACC GGG GTG AGA ACA
    ATT ACC ACT 3' (SEQ ID NO:187).

The sequence of the HCV cDNA in clone 33c, and the overlap with that in clone 40b, is shown in FIG. 15, which also shows the amino acids encoded therein.

Clone 8h was isolated using a probe based on the sequence of nucleotides in clone 33c. The nucleotide sequence of the probe was

5' AGA GAC AAC CAT GAG GTC CCC
    GGT GTT C 3' (SEQ ID NO:188).

The sequence of the HCV cDNA in clone 8h, and the overlap with that in clone 33c, and the amino acids encoded therein, are shown in FIG. 16.

Clone 7e was isolated using a probe based on the sequence of nucleotides in clone 8h. The nucleotide sequence of the probe was

5' TCG GAC CTT TAC CTG GTC ACG
    AGG CAC 3' (SEQ ID NO:189).

The sequence of HCV cDNA in clone 7e, the overlap with clone 8h, and the amino acids encoded therein, are shown in FIG. 17.

Clone 14c was isolated with a probe based on the sequence of nucleotides in clone 25c. The sequence of clone 25c is shown in FIG. 13. The probe in the isolation of clone 14c had the sequence

5'ACC TTC CCC ATT AAT GCC TAC ACC
    ACG GGC 3' (SEQ ID NO:190).

The sequence of HCV cDNA in clone 14c, its overlap with that in clone 25c, and the amino acids encoded therein are shown in FIG. 18.

Clone 8f was isolated using a probe based on the sequence of nucleotides in clone 14c. The nucleotide sequence of the probe was

5' TCC ATC TCT CAA GGC AAC TTG
    CAC CGC TAA 3' (SEQ ID NO:191).

The sequence of HCV cDNA in clone 8f, its overlap with that in clone 14c, and the amino acids encoded therein are shown in FIG. 19.

Clone 33f was isolated using a probe based on the nucleotide sequence present in clone 8f. The nucleotide sequence of the probe was

5' TCC ATG GCT GTC CGC TTC CAC
    CTC CAA AGT 3' (SEQ ID NO:192).

The sequence of HCV cDNA in clone 33f, its overlap with that in clone 8f, and the amino acids encoded therein are shown in FIG. 20.

Clone 33g was isolated using a probe based on the sequence of nucleotides in clone 33f. The nucleotide sequence of the probe was

5' GCG ACA ATA CGA CAA CAT CCT
    CTG AGC CCG 3' (SEQ ID NO:193).

The sequence of HCV cDNA in clone 33g, its overlap with that in clone 33f, and the amino acids encoded therein are shown in FIG. 21.

Clone 7f was isolated using a probe based on the sequence of nucleotides in clone 7e. The nucleotide sequence of the probe was

5' AGC AGA CAA GGG GCC TCC TAG
    GGT GCA TAA T 3' (SEQ ID NO:194).

The sequence of HCV cDNA in clone 7f, its overlap with clone 7e, and the amino acids encoded therein are shown in FIG. 22.

Clone 11b was isolated using a probe based on the sequence of clone 7f. The nucleotide sequence of the probe was

5' CAC CTA TGT TTA TAA CCA TCT
    CAC TCC TCT 3' (SEQ ID NO:195).

The sequence of HCV cDNA in clone 11b, its overlap with clone 7f, and the amino acids encoded therein are shown in FIG. 23.

Clone 14i was isolated using a probe based on the sequence of nucleotides in clone 11b. The nucleotide sequence of the probe was

5' CTC TGT CAC CAT ATT ACA AGC
    GCT ATA TCA 3' (SEQ ID NO:196).

The sequence of HCV cDNA in clone 14i, its overlap with 11b, and the amino acids encoded therein are shown in FIG. 24.

Clone 39c was isolated using a probe based on the sequence of nucleotides in clone 33g. The nucleotide sequence of the probe was

5' CTC GTT GCT ACG TCA CCA CAA
    TTT GGT GTA 3' (SEQ ID NO:197).

The sequence of HCV cDNA in clone 39c, its overlap with clone 33g, and the amino acids encoded therein are shown in FIG. 25.

IV.A.18. The Composite HCV cDNA Sequence Derived from Isolated Clones Containing HCV cDNA The HCV cDNA sequences in the isolated clones described supra have been aligned to create a composite HCV cDNA sequence. The isolated clones, aligned in the 5' to 3' direction are: 14i, 7f, 7e, 8h, 33c, 40b, 37b, 35, 36, 81, 32, 33b, 25c, 14c, 8f, 33f, 33g, and 39c.

A composite HCV cDNA sequence derived from the isolated clones, and the amino acids encoded therein, is shown in FIG. 26.

In creating the composite sequence the following sequence heterogeneities have been considered. Clone 33c contains an HCV cDNA of 800 base pairs, which overlaps the cDNAs in clones 40b and 37c. In clone 33c, as well as in 5 other overlapping clones, nucleotide #789 is a G. However, in clone 37b (see Section IV.A.11), the corresponding nucleotide is an A. This sequence difference creates an apparent heterogeneity in the amino acids encoded therein, which would be either CYS or TYR, for G or A, respectively. This heterogeneity may have important ramifications in terms of protein folding.

Nucleotide residue #2 in clone 8h HCV cDNA is a T. However, as shown infra, the corresponding residue in clone 7e is an A; moreover, an A in this position is also found in 3 other isolated overlapping clones. Thus, the T residue in clone 8h may represent a cloning artifact. Therefore, in FIG. 26, the residue in this position is designated as an A.

The 3'-terminal nucleotide in clone 8f HCV cDNA is a G. However, the corresponding residue in clone 33f, and in 2 other overlapping clones is a T. Therefore, in FIG. 26, the residue in this position is designated as a T.

The 3'-terminal sequence in clone 33f HCV cDNA is TTGC. However, the corresponding sequence in clone 33g and in 2 other overlapping clones is ATTC. Therefore, in FIG. 26, the corresponding region is represented as ATTC.

Nucleotide residue #4 in clone 33g HCV cDNA is a T. However, in clone 33f and in 2 other overlapping clones the corresponding residue is an A. Therefore, in FIG. 26, the corresponding residue is designated as an A.

The 3'-terminus of clone 14i is an AA, whereas the corresponding dinucleotide in clone 11b, and in three other clones, is TA. Therefore, in FIG. 26, the TA residue is depicted.

The resolution of other sequence heterogeneities is discussed supra.

An examination of the composite HCV cDNA indicates that it contains one large ORF. This suggests that the viral genome is translated into a large polypeptide which is processed concomitant with, or subsequent to translation.

IV.A.19. Isolation and Nucleotide Sequences of HCV cDNAs in Clones 12f, 35f, 19g, 26g, and 15e The HCV cDNAs in clones 12f, 35f, 19g, 26g, and 15e were isolated essentially by the technique described in Section IV.A.17, except that the probes were as indicated below. The frequency of clones which hybridized with the probes was approximately 1 in 50,000 in each case. The nucleotide sequences of the HCV cDNAs in these clones were determined essentially as described in Section IV.A.2., except that the cDNA from the indicated clones were substituted for the cDNA isolated from clone 5-1-1.

The isolation of clone 12f, which contains cDNA upstream of the HCV cDNA in FIG. 26, was accomplished using a hybridization probe based on the sequence of nucleotides in clone 14i. The nucleotide sequence of the probe was

5' TGC TTG TGG ATG ATG CTA CTC ATA
    TCC CAA 3'     (SEQ ID NO:198).

The HCV cDNA sequence of clone 12f, its overlap with clone 14i, and the amino acids encoded therein are shown in FIG. 27.

The isolation of clone 35f, which contains cDNA downstream of the HCV cDNA in FIG. 26, was accomplished using a hybridization probe based on the sequence of nucleotides in clone 39c. The nucleotide sequence of the probe was

5' AGC AGC GGC GTC AAA AGT GAA
    GGC TAA CTT 3'     (SEQ ID NO:199).

The sequence of clone 35f, its overlap with the sequence in clone 39c, and the amino acids encoded therein are shown in FIG. 28.

The isolation of clone 19g was accomplished using a hybridization probe based on the 3' sequence of clone 35f. The nucleotide sequence of the probe was

5' TTC TCG TAT GAT ACC CGC TGC
    TTT GAC TCC 3'     (SEQ ID NO:200).

The HCV cDNA sequence of clone 19g, its overlap with the sequence in clone 35f, and the amino acids encoded therein are shown in FIG. 29.

The isolation of clone 26g was accomplished using a hybridization probe based on the 3' sequence of clone 19g. The nucleotide sequence of the probe was

5' TGT GTG GCG ACG ACT TAG TCG
    TTA TCT GTG 3'     (SEQ ID NO:201).

The HCV cDNA sequence of clone 26g, its overlap with the sequence in clone 19g, and the amino acids encoded therein are shown in FIG. 30.

Clone 15e was isolated using a hybridization probe based on the 3' sequence of clone 26g. The nucleotide sequence of the probe was

5' CAC ACT CCA GTC AAT TCC TGG
    CTA GGC AAC 3'     (SEQ ID NO:202).

The HCV cDNA sequence of clone 15e, its overlap with the sequence in clone 26g, and the amino acids encoded therein are shown in FIG. 31.

The HCV cDNA sequences in the isolated clones described supra. have been aligned to create a composite HCV cDNA sequence. The isolated clones, aligned in the 5' to 3' direction are: 12f, 14i, 7f, 7e, 8h, 33c, 40b, 37b, 35, 36, 81, 32, 33b, 25c, 14c, 8f 33f, 33g, 39c, 35f, 19g, 26g, and 15e.

A composite HCV cDNA sequence derived from the isolated clones, and the amino acids encoded therein, is shown in FIG. 32.

IV.A.20. Alternative Method of Isolating cDNA Sequences Upstream of the HCV cDNA Sequence in Clone 12f Based on the most 5' HCV sequence in FIG. 32, which is derived from the HCV cDNA in clone 12f, small synthetic oligonucleotide primers of reverse transcriptase are synthesized and used to bind to the corresponding sequence in HCV genomic RNA, to prime reverse transcription of the upstream sequences. The primer sequences are proximal to the known 5'-terminal sequence of clone 12f, but sufficiently downstream to allow the design of probe sequences upstream of the primer sequences. Known standard methods of priming and cloning are used. The resulting cDNA libraries are screened with sequences upstream of the priming sites (as deduced from the elucidated sequence in clone 12f). The HCV genomic RNA is obtained from either plasma or liver samples from chimpanzees with NANBH, or from analogous samples from humans with NANBH.

IV.A.21. Alternative Method Utilizing Tailing to Isolate Sequences from the 5'-Terminal Region of the HCV Genome In order to isolate the extreme 5'-terminal sequences of the HCV RNA genome, the cDNA product of the first round of reverse transcription, which is duplexed with the template RNA, is tailed with oligo C. This is accomplished by incubating the product with terminal transferase in the presence of CTP. The second round of cDNA synthesis, which yields the complement of the first strand of cDNA, is accomplished utilizing oligo G as a primer for the reverse transcriptase reaction. The sources of genomic HCV RNA are as described in Section IV.A.20. The methods for tailing with terminal transferase, and for the reverse transcriptase reactions are as in Maniatis et al. (1982). The cDNA products are then cloned, screened, and sequenced.

IV.A.22. Alternative Method Utilizing Tailing to Isolate Sequences from the 3'-Terminal Region of the HCV Genome This method is based on previously used methods for cloning cDNAs of Flavivirus RNA. In this method, the RNA is subjected to denaturing conditions to remove secondary structures at the 3'-terminus, and is then tailed with Poly A polymerase using rATP as a substrate. Reverse transcription of the poly A tailed RNA is catalyzed by reverse transcriptase, utilizing oligo dT as a primer. The second strands of cDNA are synthesized, the cDNA products are cloned, screened, and sequenced.

IV.A.23. Creation of λgt11 HCV cDNA Libraries Containing Larger cDNA Inserts

The method used to create and screen the λgt11 libraries are essentially as described in Section IV.A.1., except that the library is generated from a pool of larger size cDNAs eluted from the ion exchange column Sepharose® (Pharmacia) CL-4B column.

IV.A.24. Creation of HCV cDNA Libraries Using Synthetic Oligomers as Primers

New HCV cDNA libraries have been prepared from the RNA derived from the infectious chimpanzee plasma pool described in Section IV.A.1., and from the poly A⁺ RNA fraction derived from the liver of this infected animal. The cDNA was constructed essentially as described by Gubler and Hoffman (1983), except that the primers for the first cDNA strand synthesis were two synthetic oligomers based on the sequence of the HCV genome described supra. Primers based on the sequence of clone 11b and 7e were, respectively,

5' CTG GCT TGA AGA ATC 3'   (SEQ ID NO:203)

and

5' AGT TAG GCT GGT GAT TAT GC 3'   (SEQ ID NO:204).

The resulting cDNAs were cloned into λ bacteriophage vectors, and screened with various other synthetic oligomers, whose sequences were based on the HCV sequence in FIG. 32.

IV.A.25. Creation of HCV cDNA Library From Liver of a Chimpanzee with Infectious NANBH An HCV cDNA library was created from liver from the chimpanzee from which the HCV cDNA library in Section IV.A.1. was created. The technique for creating the library was similar to that in Section IV.A.24, except for this different source of the RNA, and that a primer based on the sequence of HCV cDNA in clone 11b was used. The sequence of the primer was

5' CTG GCT TGA AGA ATC 3'   . (SEQ ID NO:203)

IV.A.26. Isolation and Nucleotide Sequence of Overlapping HCV cDNA in Clone k9-1 to cDNA in Clone 11b Clone k9-1 was isolated from the HCV cDNA library created from the liver of an NANBH infected chimpanzee, as described in Section IV.A.25. The library was screened for clones which overlap the sequence in clone 11b, by using a clone which overlaps clone 11b at the 5'-terminus, clone 11e. The sequence of clone 11b is shown in FIG. 23. Positive clones were isolated with a frequency of 1 in 500,000. One isolated clone, k9-1, was subjected to further study. The overlapping nature of the HCV cDNA in clone k9-1 to the 5'-end of the HCV-cDNA sequence in FIG. 26 was confirmed by probing the clone with clone Alex46; this latter clone contains an HCV cDNA sequence of 30 base pairs which corresponds to those base pairs at the 5'-terminus of the HCV cDNA in clone 14i, described supra.

The nucleotide sequence of the HCV cDNA isolated from clone k9-1 was determined using the techniques described supra. The sequence of the HCV cDNA in clone k9-1, the overlap with the HCV cDNA in FIG. 26 (indicated by the dotted line), and the amino acids encoded therein are shown in FIG. 46.

The HCV cDNA sequence in clone k9-1 has been aligned with those of the clones described in Section IV.A.19. to create a composite HCV cDNA sequence, with the k9-1 sequence being placed upstream of the sequence shown in FIG. 32. The composite HCV cDNA which includes the k9-1 sequence, and the amino acids encoded therein, is shown in FIG. 47.

IV.A.27. Isolation and Sequence of Overlapping HCV cDNA Clones 13i, 26i, CA59a, CA84a, CA156e and CA167b The clones 13i, 26j, CA59a, CA84a, CA156e and CA167b were isolated from the λgt11 library described in Section IV.A.1. The frequencies with which positive clones appeared with the respective probes was about 1 in 50,000.

The isolation of clone 13i was accomplished using a synthetic probe derived from the sequence of clone 12f. The sequence of the probe was:

5'GAA CGT TGC GAT CTG GAA GAC
  AGG GAC AGG 3'   (SEQ ID NO:205).

The isolation of clone 26j was accomplished using a probe derived from the 5'-region of clone k9-1. The sequence of the probe was:

5'TAT CAG TTA TGC CAA CGG AAG CGG
  CCC CGA 3'   (SEQ ID NO:206).

The HCV cDNA sequences of clones 13i and 26j, are shown in FIGS. 48 and 49, respectively. Also shown are the amino acids encoded therein, as well as the overlap of clone 13i with clone 12f, and the overlap of clone 26j with clone 13i. The sequences for these clones confirmed the sequence of clone k9-1, which had been isolated from a different HCV cDNA library (see Section IV.A.26).

Clone CA59a was isolated utilizing a probe based upon the sequence of the 5'-region of clone 26j. The sequence of this probe was:

5' CTG GTT AGC AGG GCT TTT CTA TCA
   CCA CAA 3'   (SEQ ID NO:207).

A probe derived from the sequence of clone CA59a was used to isolate clone CA84a. The sequence of the probe used for this isolation was:

5' AAG GTC CTG GTA GTG CTG CTG
CTA TTT GCC 3'        (SEQ ID NO:208).

Clone CA156e was isolated using a probe derived from the sequence of clone CA84a. The sequence of the probe was:

5' ACT GGA CGA CGC AAG GTT GCA
ATT GCT CTA 3'        (SEQ ID NO:209).

Clone CA167b was isolated using a probe derived from the sequence of clone CA156e. The sequence of the probe was:

5' TTC GAC GTC ACA TCG ATC TGC
TTG TCG GGA 3'        (SEQ ID NO:210).

The nucleotide sequences of the HCV cDNAs in clones CA59a, CA84a, CA156e, and CA167b, are shown FIGS. 50, 51, 52, and 53, respectively. The amino acids encoded therein, as well as the overlap with the sequences of relevant clones, are also shown in the Figs.

IV.A.28. Creation of "pi" HCV cDNA Library

A library of HCV cDNA, the "pi" library, was constructed from the same batch of infectious chimpanzee plasma used to construct the λgt11 described in Section IV.A.1, and utilizing essentially the same techniques. However, construction of the pi library utilized a primer-extension method, in which the primer for reverse transcriptase was based on the sequence of clone CA59A. The sequence of the primer was:

5' GGT GAC GTG GGT TTC 3'        (SEQ ID NO:211).

IV.A.29. Isolation and Sequence of Clone pi14a

Screening of the "pi" HCV cDNA library described in Section IV.A.28 with the probe used to isolate clone CA167b (see Section IV.A.27.) yielded clone pi14a. The clone contains about 800 base pairs of cDNA which overlaps clones CA16i7b, CA156e, CA84a and CA59a (which were isolated from the HCV cDNA library described in Section IV.A.1.). In addition, pi14a also contains about 250 base pairs of DNA which are upstream of the HCV cDNA in clone CA167b.

The combined ORF derived from the HCV cDNA sequences in clones pi14a, CA167b, CA156e, CA84a, CA59a, k9-1, 12f, 14i, 11b, 7f, 7e, 8h, 33c, 40b, 37b, 35, 36, 81, 32, 33b, 25c, 14c, 8f, 33f, 33g, 39c, 35f, 19g, 26g, and 15e is shown in FIG. 54; also shown are the amino acids encoded therein.

IV.A.30. Isolation and Sequence of Clones CA216a, CA290a and ag30a

Based on the sequence of clone CA167b (see Section IV.A.27 and FIG. 53), a synthetic probe was made having the following sequence:

5' GGC TTT ACC ACG TCA CCA ATG ATT
GCC CTA 3'        (SEQ ID NO:212).

The above probe was used to screen the λgt11 library described in Section IV.A.1, which yielded clone CA216a, whose HCV sequences are shown in FIG. 56.

Another probe was made based on the sequence of clone CA216a having the following sequence:

5' TTT GGG TAA GGT CAT CGA TAC
CCT TAC GTG 3'        (SEQ ID NO:213).

Screening the above library with this probe yielded clone CA290a, the HCV sequences therein being shown in FIG. 57.

In a parallel approach, a primer-extension cDNA library was made using nucleic acid extracted from the same infectious plasma used in the original λgt11 cDNA library described above. The primer used was based on the sequence of clones CA216a and CA290a:

5' GAA GCC GCA CGT AAG 3'        (SEQ ID NO:214).

The cDNA library was made using methods similar to those described previously for libraries used in the isolation of clones pi14a and k9-1 (see Sections IV.A.26 and IV.A.29). The probe used to screen this library was based on the sequence of clone CA290a:

5' CCG GCG TAG GTC GCG CAA TTT
GGG TAA 3'        (SEQ ID NO:215).

Clone ag30a was isolated from the new library with the above probe, and contained about 670 basepairs of HCV sequence. See FIG. 58. Part of this sequence overlaps the HCV sequence of clones CA216a and CA290a. About 300 base-pairs of the ag30a sequence, however, is upstream of the sequence from clone CA290a. The non-overlapping sequence shows a start codon (*) and stop codons that may indicate the start of the HCV ORF. Also indicated in FIG. 58 are putative small encoded peptides (#) which may play a role in regulating translation, as well as the putative first amino acid of the putative polypeptide (/), and downstream amino acids encoded therein.

IV.A.31. Isolation and Sequence of Clone CA205a

Clone CA205a was isolated from the original λgt11 library, using a synthetic probe derived from the HCV sequence in clone CA290a (FIG. 57). The sequence of the probe was:

5' TCA GAT CGT TGG TGG AGT TTA
CTT GTT GCC 3'        (SEQ ID NO:216).

The sequence of the HCV cDNA in CA205a, shown in FIG. 59, overlaps with the cDNA sequences in both clones ag30a and CA290a. The overlap of the sequence with that of CA290a is shown by the dotted line above the sequence (the figure also shows the putative amino acids encoded in this fragment).

As observed from the HCV cDNA sequences in clones CA205a and ag30a, the putative HCV polyprotein appears to begin at the ATG start codon; the HCV sequences in both clones contain an in-frame, contiguous double stop codon (TGATAG) forty two nucleotides upstream from this ATG. The HCV ORF appears to begin after these stop codons, and to extend for at least 8907 nucleotides (see the composite HCV cDNA shown in FIG. 62).

IV.A.32. Isolation and Sequence of Clone 18g

Based on the sequence of clone ag30a (see IV.A.30 and FIG. 58) and of an overlapping clone from the original λgt11 library, CA230a, a synthetic probe was made having the following sequence:

5' CCA TAG TGG TCT GCG GAA CCG
GTG AGT ACA 3'        (SEQ ID NO:217).

Screening of the original λgt11 HCV cDNA library (described in Section IV.A.1.) with the probe yielded clone 18g, the HCV cDNA sequence of which is shown in FIG. 60. Also shown in the figure are the overlap with clone ag30a, and putative polypeptides encoded within the HCV cDNA.

The cDNA in clone 18g (C18g or 18g) overlaps that in clones ag30a and CA205a, described in Section IV.A.32. The sequence of C18g also contains the double stop codon region observed in clone ag30a. The polynucleotide region upstream of these stop codons presumably represents part of the 5'-region of the HCV genome, which may contain short ORFs, and which can be confirmed by direct sequencing of the purified HCV genome. These putative small encoded peptides may play a regulatory role in translation. The region of the HCV genome upstream of that represented by C18g can be isolated for sequence analysis using essentially the technique described in Section IC.A.20., except that the primers of reverse transcriptase are based upon the sequence of C18g. Since HCV appears to be a Flavi-like virus, it is probable that the 5'-terminus of the genome will be modified with a "cap" structure. It is known that Flavivirus genomes contain 5'-terminal "cap" structures. (Yellow Fever virus, Rice et al. (1988); Dengue virus, Hahn et al (1988); Japanese Encephalitis Virus (1987)).

IV.A.33. Isolation and Sequence of Clones from the b-HCV cDNA library

Clones containing cDNA representative of the 3'-terminal region of the HCV genome were isolated from a cDNA library constructed from the original infectious chimpanzee plasma pool which was used for the creation of the HCV cDNA λgt11 library described in Section IV.A.1. In order to create the DNA library, RNA extracted from the plasma was "tailed" with poly rA using poly (rA) polymerase, and cDNA was synthesized using oligo(dT)$_{12-18}$ as a primer for reverse transcriptase. The resulting RNA:cDNA hybrid was digested with RNAase H, and converted to double stranded HCV cDNA. The resulting HCV cDNA was cloned into λgt10, using essentially the technique described in Huynh (1985), yielding the beta (or b) HCV cDNA library. The procedures used were as follows.

An aliquot (12 mL) of the plasma was treated with proteinase K, and extracted with an equal volume of phenol saturated with 0.05M Tris-Cl, pH 7.5, 0.05% (v/v) b-mercaptoethanol, 0.1% (w/v) hydroxyquinolone, 1 mM EDTA. The resulting aqueous phase was re-extracted with the phenol mixture, followed by 3 extractions with a 1:1 mixture containing phenol and chloroform:isoamyl alcohol (24:1), followed by 2 extractions with a mixture of chloroform and isoamyl alcohol (1:1). Subsequent to adjustment of the aqueous phase to 200 mM with respect to NaCl, nucleic acids in the aqueous phase were precipitated overnight at −20° C., with 2.5 volumes of cold absolute ethanol. The precipitates were collected by centrifugation at 10,000 RPM for 40 min., washed with 70% ethanol containing 20 mM NaCl, and with 100% cold ethanol, dried for 5 min. in a desiccator, and dissolved in water.

The isolated nucleic acids from the infectious chimpanzee plasma pool were tailed with poly rA utilizing poly-A polymerase in the presence of human placenta ribonuclease inhibitor (HPRI) (purchased from Amersham Corp.), utilizing MS2 RNA as carrier. Isolated nucleic acids equivalent to that in 2 mL of plasma were incubated in a solution containing TMN (50 mM Tris HCl, pH 7.9, 10 mM MgCl$_2$, 250 mM NaCl, 2.5 mM MnCl$_2$, 2 mM dithiothreitol (DTT)), 40 mM a-[$^{32}$P] ATP, 20 units HPRI (Amersham Corp.), and about 9 to 10 units of RNase free poly-A polymerase (BRL). Incubation was for 10 min. at 37° C., and the reactions were stopped with EDTA (final concentration about 250 mM). The solution was extracted with an equal volume of phenol-chloroform, and with an equal volume of chloroform, and nucleic acids were precipitated overnight at −20° C. with 2.5 volumes of ethanol in the presence of 200 mM NaCl.

IV.A.33.a. Isolation of Clone b5a

The b HCV cDNA library was screened by hybridization using a synthetic probe, which had a sequence based upon the HCV cDNA sequence in clone 15e. The sequence of the probe was:

```
5' ATT GCG AGA TCT ACG GGG CCT
   GCT ACT CCA 3'                    (SEQ ID NO:218).
```

Screening of the library yielded clone b-5a (b5a), which contains an HCV cDNA region of approximately 1000 base pairs. The 5'-region of this cDNA overlaps clones 35f, 19g, 26g, and 15e (these clones are described supra). The region between the 3'-terminal poly-A sequence and the 3'-sequence which overlaps clone 15e, contains approximately 200 base pairs. This clone allows the identification of a region of the 3'-terminal sequence the HCV genome.

The sequence of b5a is contained within the sequence of the HCV cDNA in clone 16jh (described infra). Moreover, the sequence is also present in CC34a, isolated from the original λgt11 library. (The original λgt11 library is referred to herein as the "C" library).

IV.A.34. Isolation and Sequence of Clones Generated by PCR Amplification of the 3'-Region of the HCV Genome Multiple cDNA clones have been generated which contain nucleotide sequences derived from the 3'-region of the HCV genome. This was accomplished by amplifying a targeted region of the genome by a polymerase chain reaction technique described in Saiki et al. (1986), and in Saiki et al. (1988), which was modified as described below. The HCV RNA which was amplified was obtained from the original infectious chimpanzee plasma pool which was used for the creation of the HCV cDNA λgt11 library described in Section IV.A.1. Isolation of the HCV RNA was as described in Section IV.A.33. The isolated RNA was tailed at the 3'-end with ATP by E. coli poly-A polymerase as described in Sippel (1973), except that the nucleic acids isolated from chimp serum were substituted for the nucleic acid substrate. The tailed RNA was then reverse transcribed into cDNA by reverse transcriptase, using an oligo dT-primer adapter, essentially as described by Han (1987), except that the components and sequence of the primer-adapter were:

```
Stuffer NotI  SP6 Promoter Primer       (SEQ ID NO:219)
AATTC  GCGGCCGC CATACGATTTAGGTGACACTATAGAA T₁₅.
```

The resultant cDNA was subjected to amplification by PCR using two primers:

```
Primer         Sequence                    (SEQ ID NO:220)
JH32(30mer) ATAGCGGCCGCCCTCGATTGCGAGATCTAC
                                           (SEQ ID NO:221)
JH11(20mer) AATTCGGGCGGCCGCCATACGA.
```

The JH32 primer contained 20 nucleotide sequences hybridizable to the 5'-end of the target region in the cDNA, with an estimated $T_m$ of 66° C. The JH11 was derived from a portion of the oligo dT-primer adapter; thus, it is specific to the 3'-end of the cDNA with a $T_m$ of 64° C. Both primers were designed to have a recognition site for the restriction enzyme, NotI, at the 5'-end, for use in subsequent cloning of the amplified HCV cDNA.

The PCR reaction was carried out by suspending the cDNA and the primers in 100 mL of reaction mixture containing the four deoxynucleoside triphosphates, buffer salts and metal ions, and a thermostable DNA polymerase isolated from *Thermus aquaticus* (Taq polymerase), which are in a Perkin Elmer Cetus PCR kit (N801-0043 or N801-0055). The PCR reaction was performed for 35 cycles in a Perkin Elmer Cetus DNA thermal cycler. Each cycle consisted of a 1.5 min denaturation step at 94° C., an annealing step at 60° C. for 2 min, and a primer extension step at 72° C. for 3 min. The PCR products were subjected to Southern blot analysis using a 30 nucleotide probe, JH34, the sequence of which was based upon that of the 3'-terminal region of clone 15e. The sequence of JH34 is:

5' CTT GAT CTA CCT CCA ATC ATT CAA
    AGA CTC 3'    (SEQ ID NO:222).

The PCR products detected by the HCV cDNA probe ranged in size from about 50 to about 400 base pairs.

In order to clone the amplified HCV cDNA, the PCR products were cleaved with NotI and size selected by polyacrylamide gel electrophoresis. DNA larger than 300 base pairs was cloned into the NotI site of pUC18S The vector pUC18S is constructed by including a NotI polylinker cloned between the EcoRI and SalI sites of pUC18. The clones were screened for HCV cDNA using the JH34 probe. A number of positive clones were obtained and sequenced. The nucleotide sequence of the HCV cDNA insert in one of these clones, 16jh, and the amino acids encoded therein, are shown in FIG. 61. A nucleotide heterogeneity, detected in the sequence of the HCV cDNA in clone 16jh as compared to another clone of this region, is indicated in the figure.

IV.A.35. Compiled HCV cDNA Sequence

The HCV cDNA sequence compiled from a series of overlapping clones derived from the various HCV cDNA libraries described supra and infra is shown in FIG. 62. The clones from which the sequence was derived are b114a, 18g, ag30a, CA205a, CA290a, CA216a, pi14a, CA167b, CA156e, CA84a, CA59a, K9-1 (also called k9-1), 26j, 13i, 12f, 14i, 11b, 7f, 7e, 8h, 33c, 40b, 37b, 35, 36, 81, 32, 33b, 25c, 14c, 8f, 33f, 33g, 39c, 35f, 19g, 26g, 15e, b5a, and 16jh. In the figure the three dashes above the sequence indicate the position of the putative initiator methionine codon.

Clone b114a was obtained using the cloning procedure described for clone b5a, supra, except that the probe was the synthetic probe used to detect clone 18g, supra. Clone b114a overlaps with clones 18g, ag30a, and CA205a, except that clone b114a contains an extra two nucleotides upstream of the sequence in clone 18g (i.e., 5'-CA). These extra two nucleotides have been included in the HCV genomic sequence shown in FIG. 62.

It should be noted that although several of the clones described supra have been obtained from libraries other than the original HCV cDNA λgt11 library described in Section IV.A.1., these clones contain HCV cDNA sequences which overlap HCV cDNA sequences in the original library. Thus, essentially all of the HCV sequence is derivable from the original λgt11 library which was used to isolate the first clone (5-1-1).

IV.A.36. Isolation and Sequence of Clone 6k

Based on the sequence of clone 16jh and clone b5a (see IV.A.34. and FIG. 61), a synthetic probe was made having the following sequence:

5' TCT TCA ACT GGG CAG TAA GAA
    CAA AGC TCA 3'    (SEQ ID NO:223).

Screening of the original λgt11 HCV cDNA library (described in Section IV.A.1.) with the probe yielded clones with a frequency of approximately 1 in $10^6$; one of these was called clone 6k (also called C6k), the HCV cDNA sequence of which is shown in FIG. 71. Also shown in the figure are the overlap with clone 16jh, and putative polypeptides encoded within the HCV cDNA. Sequence information on the HCV cDNA in clone 6k was obtained from only one strand. Information on the deposit of this clone is provided infra, wherein the clone is listed as λgt11 C6k. Confirmation of the C6K sequence as part of an ORF encoding HCV1 polypeptide has been obtained by sequencing other overlapping clones.

A composite of the HCV cDNA sequence derived from overlapping clones b114a, 18g, ag30a, CA205a, CA290a, CA216a, pi14a, CA167b, CA156e, CA84a, CA59a, K9-1 (also called k9-1), 26j, 13i, 12f, 14i, 11b, 7f, 7e, 8h, 33c, 40b, 37b, 35, 36, 81, 32, 33b, 25c, 14c, 8f, 33f, 33g, 39c, 35f, 19g, 26g, 15e, b5a, 16jh, and 16k is shown in FIG. 72. The figure also shows the amino acids encoded in the sense strand of the cDNA, which is the equivalent of the genomic RNA.

IV.A.36. Construction of pS3-56$_{C100m}$

The vector pS3-56$_{C100}$ contains a construct which encodes the fusion polypeptide SOD-C100 (see Section IV.B.4.). In addition, this vector contains an ms2 phage sequence, which was removed from the HCV C100 encoding sequence by digestion of pS3-56$_{C100}$ with XmaI and SalI, followed by isolation of the large fragment. The aforementioned digestion, however, removes some of the HCV sequence. The latter was recreated by ligation of the fragment with the following linkers, which also introduced a SalI site and a stop codon. The linker sequences, annealed to each other, are shown in FIG. 73. The resulting vector is called pS3-56$_{C100m}$ (also called pS356$_{C100m}$).

IV.A.37. Construction of Composite Sequence C200

An HCV-cDNA sequence, C200, which is a composite of HCV sequences derived from clones 33c, 31, and 35, was constructed. Clones 33c and 35 are described in Section IV.A.17. and IV.A.8., respectively. Clone 31 is from the C library, and has one difference from the confirmed sequence of HCV-1 in FIG. 62. The sequence of clone 31 is shown in FIG. 74, which also shows the amino acids encoded therein, and the location of restriction enzyme sites within the HCV cDNA. A C200 cassette was constructed by ligating together a 718 bp fragment obtained by digestion of clone 33c DNA with EcoRI and HinfI, a 179 bp fragment obtained by digestion of clone 31 DNA with HinfI and BglI, and a 377 bp fragment obtained by digestion of clone 35 DNA with BglI and EcoRI. The construct of ligated fragments were inserted into the EcoRI site of pBR322, yielding the plasmid pBR322-C200.

IV.A.38. Isolation and Sequence of Clone p131jh

A clone containing sequence from the 3'-region of the HCV genome, and which contains an in-frame stop codon, was isolated essentially as described in Section IV.A.34, except that HCV1 RNA was converted to cDNA using the oligonucleotide 5' AAT TCG CGG CCG CCA TAC GAT TTA GGT GAC ACT
    ATA GAA T$_{15}$ 3'    (SEQ ID NO:224).

The cDNA was then amplified by the PCR reaction using the primers:

5' TTC GCG GCC GCT ACA GCG GGG
    GAG ACA T 3'    (SEQ ID NO:225)

and

5' AAT TCG CGG CCG CCA TAC GA 3'    (SEQ ID NO:226).

After amplification, the PCR products were precipitated with spermine, digested with NotI, and extracted with phenol. The purified products were cloned into the NotI site of pUC18S, and HCV positive clones were selected using the oligonucleotide:

5' CGA TGA AGG TTG GGG TAA ACA
　　CTC CGG CCT 3'　　　　　　　　　　　(SEQ ID NO:227).

The HCV cDNA in one clone, designated p131jh, is shown in FIG. 75. This clone contains an in-frame stop codon for the large ORF contained in the HCV genome.

IV.B. Expression and Purification of Polypeptides Encoded Within HCV cDNAs and Identification of the Expressed Products as HCV Induced Antigens.

IV.B.1. Expression of the Polypeptide Encoded in Clone 5-1-1.

The HCV polypeptide encoded within clone 5-1-1 (see Section IV.A.2., supra) was expressed as a fusion polypeptide with superoxide dismutase (SOD). This was accomplished by subcloning the clone 5-1-1 cDNA insert into the expression vector pSODcf1 (Steimer et al. (1986)) as follows.

First, DNA isolated from pSODcf1 was treated with BamHI and EcoRI, and the following linker was ligated into the linear DNA created by the restriction enzymes:

5' GAT CCT GGA ATT CTG ATA AGA CCT TAA GAC TAT
　　TTT AA 3'　　　　　　　　　　　　　　　(SEQ ID NO:228)

After cloning, the plasmid containing the insert was isolated.

Plasmid containing the insert was restricted with EcoRI. The HCV cDNA insert in clone 5-1-1 was excised with EcoRI, and ligated into this EcoRI linearized plasmid DNA. The DNA mixture was used to transform $E.$ $coli$ strain D1210 (Sadler et al. (1980)). Recombinants with the 5-1-1 cDNA in the correct orientation for expression of the ORF shown in FIG. 1 were identified by restriction mapping and nucleotide sequencing.

Recombinant bacteria from one clone were induced to express the SOD-NANB$_{5-1-1}$ polypeptide by growing the bacteria in the presence of IPTG.

IV.B.2. Expression of the Polypeptide Encoded in Clone 81.

The HCV cDNA contained within clone 81 was expressed as a SOD-NANB$_{81}$ fusion polypeptide. The method for preparing the vector encoding this fusion polypeptide was analogous to that used for the creation of the vector encoding SOD-NANB$_{5-1-1}$, except that the source of the HCV cDNA was clone 81, which was isolated as described in Section IV.A.3, and for which the cDNA sequence was determined as described in Section IV.A.4. The nucleotide sequence of the HCV cDNA in clone 81, and the putative amino acid sequence of the polypeptide encoded therein are shown in FIG. 4.

The HCV cDNA insert in clone 81 was excised with EcoRI, and ligated into the pSODcf1 which contained the linker (see IV.B.1.) and which was linearized by treatment with EcoRI. The DNA mixture was used to transform $E.$ $coli$ strain D1210. Recombinants with the clone 81 HCV cDNA in the correct orientation for expression of the ORF shown in FIG. 4 were identified by restriction mapping and nucleotide sequencing.

Recombinant bacteria from one clone were induced to express the SOD-NANB$_{81}$ polypeptide by growing the bacteria in the presence of IPTG.

IV.B.3. Identification of the Polypeptide Encoded Within Clone 5-1-1 as an HCV and NANBH Associated Antigen.

The polypeptide encoded within the HCV cDNA of clone 5-1-1 was identified as a NANBH associated antigen by demonstrating that sera of chimpanzees and humans infected with NANBH reacted immunologically with the fusion polypeptide, SOD-NANB$_{5-1-1}$, which is comprised of superoxide dismutase at its N-terminus and the in-frame 5-1-1 antigen at its C-terminus. This was accomplished by "Western" blotting (Towbin et al. (1979)) as follows.

A recombinant strain of bacteria transformed with an expression vector encoding the SOD-NANB$_{5-1-1}$ polypeptide, described in Section IV.B.I., was induced to express the fusion polypeptide by growth in the presence of IPTG. Total bacterial lysate was subjected to electrophoresis through polyacrylamide gels in the presence of SDS according to Laemmli (1970). The separated polypeptides were transferred onto nitrocellulose filters (Towbin et al. (1979)). The filters were then cut into thin strips, and the strips were incubated individually with the different chimpanzee and human sera. Bound antibodies were detected by further incubation with $^{125}$I-labeled sheep anti-human Ig, as described in Section IV.A.1.

Figure 33B:
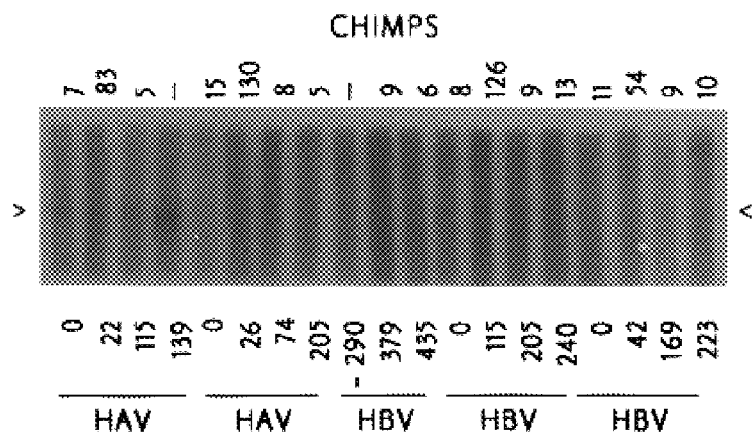

The characterization of the chimpanzee sera used for the Western blots and the results, shown in the photograph of the autoradiographed strips, are presented in FIG. 33. Nitrocellulose strips containing polypeptides were incubated with sera derived from chimpanzees at different times during acute NANBH (Hutchinson strain) infections (lanes 1–16), hepatitis A infections (lanes 17–24, and 26–33), and hepatitis B infections (lanes 34–44). Lanes 25 and 45 show positive controls in which the immunoblots were incubated with serum from the patient used to identify the recombinant clone 5-1-1 in the original screening of the λgt11 cDNA library (see Section IV.A.1.).

The band visible in the control lanes, 25 and 45, in FIG. 23 reflects the binding of antibodies to the NANB$_{5-1-1}$ moiety of the SOD fusion polypeptide. These antibodies do not exhibit binding to SOD alone, since this has also been included as a negative control in these samples, and would have appeared as a band migrating significantly faster than the SOD-NANB$_{5-1-1}$ fusion polypeptide.

Lanes 1–16 of FIG. 33 show the binding of antibodies in sera samples of 4 chimpanzees; the sera were obtained just prior to infection with NANBH, and sequentially during acute infection. As seen from the figure, whereas antibodies which reacted immunologically with the SOD-NANB$_{5-1-1}$ polypeptide were absent in sera samples obtained before administration of infectious HCV inoculum and during the early acute phase of infection, all 4 animals eventually induced circulating antibodies to this polypeptide during the late part of, or following the acute phase. Additional bands observed on the immunoblots in the cases of chimps numbers 3 and 4 were due to background binding to host bacterial proteins.

In contrast to the results obtained with sera from chimps infected with NANBH, the development of antibodies to the NANB$_{5-1-1}$ moiety of the fusion polypeptide was not observed in 4 chimpanzees infected with HAV or 3 chimpanzees infected with HBV. The only binding in these cases was background binding to the host bacterial proteins, which also occurred in the HCV infected samples.

Figure 34A:
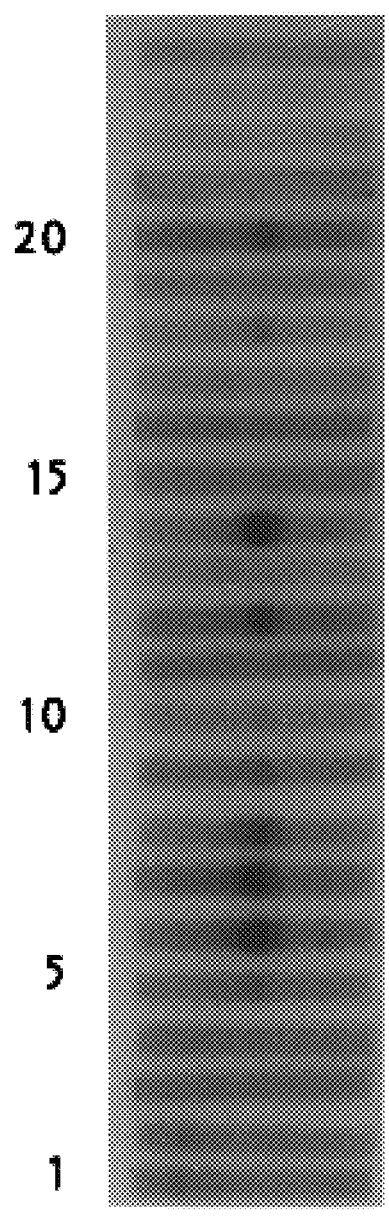
FIG. 34 shows a photograph of Western blots of a fusion protein, SOD-NANB$_{5-1-1}$, with serum from humans infected with NANBV, HAV, HBV, and from control humans.
Figure 34B:
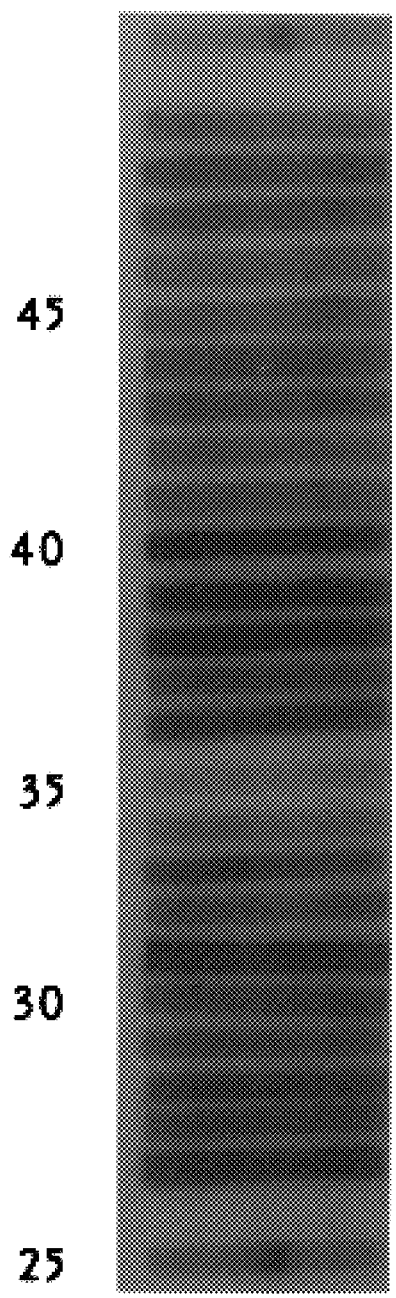

The characterization of the human sera used for the Western blots, and the results, which are shown in the photograph of the autoradiographed strips, are presented in FIG. 34. Nitrocellulose strips containing polypeptides were incubated with sera derived from humans at different times during infections with NANBH (lanes 1–21), HAV (lanes 33–40), and HBV (lanes 41–49). Lanes 25 and 50 show positive controls in which the immunoblots were incubated with serum from patient used in the original screening of the λgt11 library, described supra. Lanes 22–24 and 26–32 show "non-infected" controls in which the sera was from "normal" blood donors.

As seen in FIG. 34, sera from nine NANBH patients, including the serum used for screening the λgt11 library, contained antibodies to the $NANB_{5-1-1}$ moiety of the fusion polypeptide. Sera from three patients with NANBH did not contain these antibodies. It is possible that the anti-$NANB_{5-1-1}$ antibodies will develop at a future date in these patients. It is also possible that this lack of reaction resulted from a different NANBV agent being causative of the disease in the individuals from which the non-responding serum was taken.

FIG. 34 also shows that sera from many patients infected with HAV and HBV did not contain anti-$NANB_{5-1-1}$ antibodies, and that these antibodies were also not present in the sera from "normal" controls. Although one HAV patient (lane 36) appears to contain anti-$NANB_{5-1-1}$ antibodies, it is possible that this patient had been previously infected with HCV, since the incidence of NANBH is very high and since it is often subclinical.

These serological studies indicate that the cDNA in clone 5-1-1 encodes epitopes which are recognized specifically by sera from patients and animals infected with BB-NANBV. In addition, the cDNA does not appear to be derived from the primate genome. A hybridization probe made from clone 5-1-1 or from clone 81 did not hybridize to "Southern" blots of control human and chimpanzee genomic DNA from uninfected individuals under conditions where unique, single-copy genes are detectable. These probes also did not hybridize to Southern blots of control bovine genomic DNA.

IV.B.4. Expression of the Polypeptide Encoded in a Composite of the HCV cDNAs in Clones 36, 81 and 32

The HCV polypeptide which is encoded in the ORF which extends through clones 36, 81 and 32 was expressed as a fusion polypeptide with SOD. This was accomplished by inserting the composite cDNA, C100, into an expression cassette which contains the human superoxide dismutase gene, inserting the expression cassette into a yeast expression vector, and expressing the polypeptide in yeast.

An expression cassette containing the composite C100 cDNA derived from clones 36, 81, and 32, was constructed by inserting the ~1270 bp EcoRI fragment into the EcoRI site of the vector pS3-56 (also called pS356), yielding the plasmid pS3-56$_{C100}$. The construction of C100 is described in Section IV.A.16, supra.

The vector pS3-56, which is a pBR322 derivative, contains an expression cassette which is comprised of the ADH2/GAPDH hybrid yeast promoter upstream of the human superoxide dismutase gene, and a downstream α-factor transcription terminator. A similar cassette, which contains these control elements and the superoxide dismutase gene has been described in Cousens et al. (1987), and in copending application EPO 196,056, published Oct. 1, 1986, which is commonly owned by the herein assignee. The cassette in pS3-56, however, differs from that in Cousens et al. (1987) in that the heterologous proinsulin gene and the immunoglobulin hinge are deleted, and in that the $gln_{154}$ of the superoxide dismutase is followed by an adaptor sequence which contains an EcoRI site. The sequence of the adaptor is:

5'-AAT TTG GGA ATT CCA TAA TGA GAC CCT TAA GGT
ATT ACT CAG CT 3' (SEQ ID NO:229).

The EcoRI site allows the insertion of heterologous sequences which, when expressed from a vector containing the cassette, yield polypeptides which are fused to superoxide dismutase via an oligopeptide linker containing the amino acid sequence:

-Asn-Leu-Gly-Ile-Arg- (SEQ ID NO:230).

After recombinants containing the C100 cDNA insert in the correct orientation were isolated, the expression cassette containing the C100 cDNA was excised from pS3-56$_{C100}$ with BamHI, and a fragment of 3400 bp which contains the cassette was isolated and purified. This fragment was then inserted into the BamHI site of the yeast vector pAB24.

Figure 35:
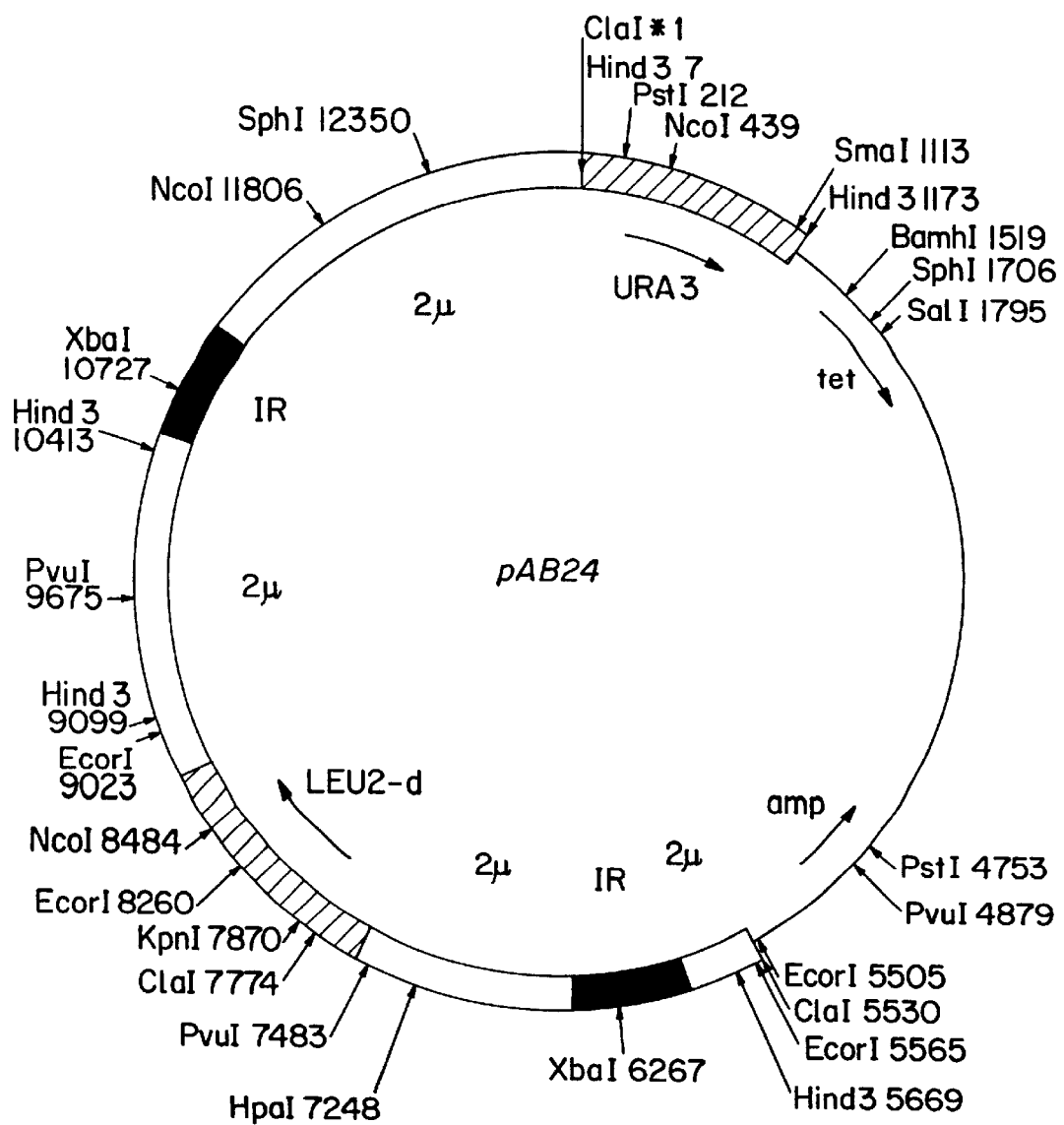
FIG. 35 is a map showing the significant features of the vector pAB24.

Plasmid pAB24, the significant features of which are shown in FIG. 35, is a yeast shuttle vector which contains the complete 2m sequence for replication [Broach (1981)] and pBR322 sequences. It also contains the yeast URA3 gene derived from plasmid YEp24 [Botstein et al. (1979)], and the yeast $LEU_{2d}$ gene derived from plasmid pC1/1. EPO Pub. No. 116,201. Plasmid pAB24 was constructed by digesting YEp24 with EcoRI and religating the vector to remove the partial 2m sequences. The resulting plasmid, YEP24DRI, was linearized by digestion with ClaI and ligated with the complete 2m plasmid which had been linearized with ClaI. The resulting plasmid, pCBou, was then digested with XbaI and the 8605 bp vector fragment was gel isolated. This isolated XbaI fragment was ligated with a 4460 bp XbaI fragment containing the $LEU_{2d}$ gene isolated from pC1/1; the orientation of the $LEU_{2d}$ gene is in the same direction as the URA3 gene. Insertion of the expression was in the unique BamHI site of the pBR322 sequence, thus interrupting the gene for bacterial resistance to tetracycline.

The recombinant plasmid which contained the SOD-C100 expression cassette, pAB24C100-3, was transformed into yeast strain JSC 308, as well as into other yeast strains. The cells were transformed as described by Hinnen et al. (1978), and plated onto ura-selective plates. Single colonies were inoculated into leu-selective media and grown to saturation. The culture was induced to express the SOD-C100 polypeptide (called C100-3) by growth in YEP containing 1% glucose.

Strain JSC 308 is of the genotype MAT @, leu2, ura3(del) DM15 (GAP/ADR1) integrated at the ADR1 locus. In JSC 308, over-expression of the positive activator gene product, ADR1, results in hyperderepression (relative to an ADR1 wild type control) and significantly higher yields of expressed heterologous proteins when such proteins are synthesized via an ADH2 UAS regulatory system. The construction of the yeast strain JSC 308 is disclosed in copending application, U.S. Ser. No. 190,868, filed concurrently herewith, and which is hereby incorporated herein by reference.

The complete C100-3 fusion polypeptide encoded in pAB24C100-3 should contain 154 amino acids of human SOD at the amino-terminus, 5 amino acid residues derived from the synthetic adaptor containing the EcoRI site, 363 amino acid residues derived from C100 cDNA, and 5 carboxy-terminal amino acids derived from the MS2 nucleotide sequence adjoining the HCV cDNA sequence in clone 32. (see Section IV.A.7.) The putative amino acid sequence of the carboxy-terminus of this polypeptide, beginning at the penultimate Ala residue of SOD, is shown in FIG. 36; also shown is the nucleotide sequence encoding this portion of the polypeptide.

IV.B.4.b. Contents of Selective Media For Yeast Auxotrophs

Leu- Medium

| Yeast Minimal Media | 850 mL |
|---|---|
| Leu-Supplements (10x) | 100 mL |
| 50% Glucose (in MILLI-Q) | 40 mL |

Yeast Minimal Medium

| Yeast Nitrogen Base w/o amino acids | 6.7 g |
|---|---|
| MILLI Q water | q.s. to 850 mL |

Leu- Supplements

| Adenine | 0.8 g |
|---|---|
| Uridine | 0.6 g |
| L-Tryptophan | 0.4 g |
| L-Histidine | 0.4 g |
| L-Arginine | 0.4 g |
| L-Methionine | 0.4 g |
| L-Tyrosine | 0.6 g |
| L-Lysine | 0.6 g |
| L-Phenylalanine | 0.96 g |

Add all components to a coffee grinder and grind until the powder is homogenous. The powder may be added to a solution or the mix can be autoclaved as a 10× concentrated solution by adding 2 L of MILLI-Q water.

Ura-/Sorbitol Plates

| Ura-/Sorbitol Medium for Plates | 500 mL |
|---|---|
| 50% Glucose | 20 mL |
| 20% Casamino acids | 12.5 mL |
| 1% Adenine | 2.5 mL |
| 1% Tryptophan | 2.5 mL |

Stir gently and pour into plates. Flame plates.

Ura- Sorbitol Medium

| D-Sorbitol | 91. g |
|---|---|
| Agar | 10. g |
| Yeast Nitrogen Base w/o amino acids | 3.35 g |
| Water | q.s. to 450. mL |

Autoclave for 30 minutes

YEP

| Peptone | 20 g |
|---|---|
| Yeast Extract | 10 g |
| MILLI Q Water | q.s. to 1000 mL |

Autoclave at 121° C. for 30 minutes. The solution is good for six months when stored at 15 to 30° C.

Leu- Plates

| Leu-Plate Medium | 950 mL |
|---|---|
| 50% Glucose | 40 mL |
| 5% Threonine | 4 mL |
| 1% Adenine | 1 mL |

Leu- Medium for Plates

| Agar | 20 g |
|---|---|
| Leu-Supplements | 0.25 g |
| 10x Basal Salts w/o amino acids | 100 mL |
| MILLI Q | q.s to 950 mL |

10× Basal Salts

| Yeast Nitrogen Base w/o Amino Acids | 66.8 g |
|---|---|
| Succinic Acid | 100. g |
| NaOH | 60. g |
| MILLI Q Water | q.s to 1000. mL |

Filter Sterilize.

Leu-, Ura- plates

| Leu-, Ura-Plate media | 840 mL |
|---|---|
| 50% Glucose | 160 mL |
| 5% Theonine | 8 mL |

Leu-, Ura- Plate Medium

| Yeast Nitrogen Base w/o amino acids | 6.7 g |
|---|---|
| Bacto Agar | 20 g |
| Leu-, Ura-supplements | 0.5 g |

(Note: the Leu-, Ura- supplement recipe is the same as the Leu- supplement recipe, except that uridine is not added.)

IV.B.5. Identification of the Polypeptide Encoded within C100 as an NANBH Associated Antigen The C100-3 fusion polypeptide expressed from plasmid pAB24C100-3 in yeast strain JSC 308 was characterized with respect to size, and the polypeptide encoded within C100 was identified as an NANBH-associated antigen by its immunological reactivity with serum from a human with chronic NANBH.

The C100-3 polypeptide, which was expressed as described in Section IV.B.4., was analyzed as follows. Yeast JSC 308 cells were transformed with pAB24, or with pAB24C100-3, and were induced to express the heterologous plasmid encoded polypeptide. The induced yeast cells in 1 mL of culture ($OD_{650nm}$ ~20) were pelleted by centrifugation at 10,000 rpm for 1 minute, and were lysed by vortexing them vigorously (10×1 min) with 2 volumes of solution and 1 volume of glass beads (0.2 mm diameter). The solution contained 50 mM Tris-HCl, pH 8.0, 1 mM EDTA, 1 mM phenylmethylsulfonyl fluoride (PMSF), and 1 mg/mL pepstatin. Insoluble material in the lysate, which includes the C100-3 polypeptide, was collected by centrifugation (10,000 rpm for 5 minutes), and was dissolved by boiling for 5 minutes in Laemmli SDS sample buffer. (See Laemmli (1970)). An amount of polypeptides equivalent to that in 0.3 mL of the induced yeast culture was subjected to electrophoresis through 10% polyacrylamide gels in the presence of SDS according to Laemmli (1970). Protein standards were co-electrophoresed on the gels. Gels containing the expressed polypeptides were either stained with Coomassie brilliant blue, or were subjected to "Western" blotting as described in Section IV.B.2., using serum from a patient with chronic NANBH to determine the immunological reactivity of the polypeptides expressed from pAB24 and from pAB24C100-3.

Figure 37A:
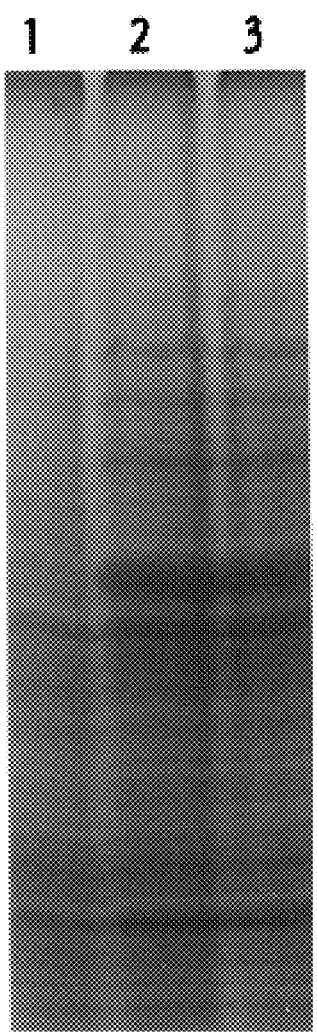
FIG. 37A is a photograph of a coomassie blue stained polyacrylamide gel which identifies C100-3 expressed in yeast.

The results are shown in FIG. 37. In FIG. 37A the polypeptides were stained with Coomassie brilliant blue. The insoluble polypeptide(s) from JSC 308 transformed with pAB24 and from two different colonies of JSC transformed with pAB24C100-3 are shown in lane 1 (pAB24), and lanes 2 and 3, respectively. A comparison of lanes 2 and 3 with lane 1 shows the induced expression of a polypeptide corresponding to a molecular weight of ~54,000 daltons from JSC 308 transformed with pAB24C100-3, which is not induced in JSC 308 transformed with pAB24. This polypeptide is indicated by the arrow.

Figure 37B:
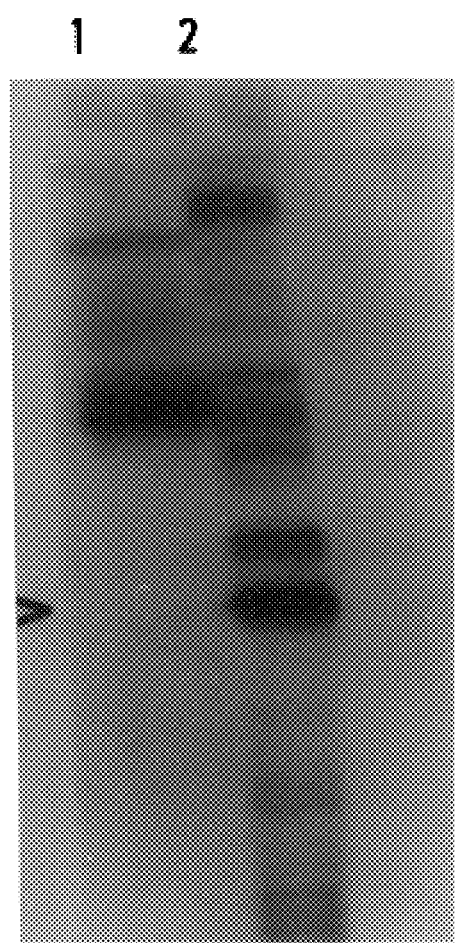
FIG. 37B shows a Western blot of C100-3 with serum from a NANBV infected human.

FIG. 37B shows the results of the Western blots of the insoluble polypeptides expressed in JSC 308 transformed with pAB24 (lane 1), or with pAB24C100-3 (lane 2). The polypeptides expressed from pAB24 were not immunologically reactive with serum from a human with NANBH. However, as indicated by the arrow, JSC 308 transformed with pAB24C100-3 expressed a polypeptide of ~54,000 dalton molecular weight which did react immunologically with the human NANBH serum. The other immunologically reactive polypeptides in lane 2 may be degradation and/or aggregation products of this ~54,000 dalton polypeptide.

IV.B.6. Purification of Fusion Polypeptide C100-3

The fusion polypeptide, C100-3, comprised of SOD at the N-terminus and in-frame C100 HCV-polypeptide at the C-terminus was purified by differential extraction of the insoluble fraction of the extracted host yeast cells in which the polypeptide was expressed.

The fusion polypeptide, C100-3, was expressed in yeast strain JSC 308 transformed with pAB24C100-3, as described in Section IV.B.4. The yeast cells were then lysed by homogenization, the insoluble material in the lysate was extracted at pH 12.0, and C100-3 in the remaining insoluble fraction was solubilized in buffer containing SDS.

The yeast lysate was prepared essentially according to Nagahuma et al. (1984). A yeast cell suspension was prepared which was 33% cells (v/v) suspended in a solution (Buffer A) containing 20 mM Tris HCl, pH 8.0, 1 mM dithiothreitol, and 1 mM phenylmethylsulfonylfluoride (PMSF). An aliquot of the suspension (15 mL) was mixed with an equal volume of glass beads (0.45–0.50 mm diameter), and the mixture was vortexed at top speed on a Super Mixer (Lab Line Instruments, Inc.) for 8 min. The homogenate and glass beads were separated, and the glass beads were washed 3 times with the same volume of Buffer A as the original packed cells. After combining the washes and homogenate, the insoluble material in the lysate was obtained by centrifuging the homogenate at 7,000×g for 15 minutes at 4° C., resuspending the pellets in Buffer A equal to twice the volume of original packed cells, and repelleting the material by centrifugation at 7,000×g for 15 min. This washing procedure was repeated 3 times.

The insoluble material from the lysate was extracted at pH 12.0 as follows. The pellet was suspended in buffer containing 0.5 M NaCl, 1 mM EDTA, where the suspending volume was equal to 1.8 times the of the original packed cells. The pH of the suspension was adjusted by adding 0.2 volumes of 0.4 M Na phosphate buffer, pH 12.0. After mixing, the suspension was centrifuged at 7,000×g for 15 min at 4° C., and the supernatant removed. The extraction was repeated 2 times. The extracted pellets were washed by suspending them in 0.5 M NaCl, 1 mM EDTA, using a suspension volume equal to two volumes of the original packed cells, followed by centrifugation at 7,000×g for 15 min at 4° C.

The C100-3 polypeptide in the extracted pellet was solubilized by treatment with SDS. The pellets were suspended in Buffer A equal to 0.9 volumes of the original packed cell volume, and 0.1 volumes of 2% SDS was added. After the suspension was mixed, it was centrifuged at 7,000×g for 15 min at 4° C. The resulting pellet was extracted 3 more times with SDS. The resulting supernatants, which contained C100-3 were pooled.

This procedure purifies C100-3 more than 10-fold from the insoluble fraction of the yeast homogenate, and the recovery of the polypeptide is greater than 50%.

The purified preparation of fusion polypeptide was analyzed by polyacrylamide gel electrophoresis according to Laemmli (1970). Based upon this analysis, the polypeptide was greater than 80% pure, and had an apparent molecular weight of ~54,000 daltons.

IV.B.7.a. Purification of Fusion Polypeptide C100-3 (Alternate method 1)

The fusion polypeptide, C100-3 (HCV c100-3), expressed in yeast strain JSC 308 transformed with pAB24C100-3, may be purified by an alternative method. In this method the antigen is precipitated from the crude cell lysate with acetone; the acetone precipitated antigen is then subjected to ion-exchange chromatography, and further purified by gel filtration.

The transformed yeast are grown under conditions which allow expression (see Section IV.B.4). A cell lysate is prepared by suspending the cells in Buffer A (20 mM Tris HCl, pH 8.0, 1 mM EDTA, 1 mM PMSF. The cells are broken by grinding with glass beads in a Dynomill type homogenizer or its equivalent. The extent of cell breakage is monitored by counting cells under a microscope with phase optics. Broken cells appear dark, while viable cells are light-colored. The percentage of broken cells is determined.

When the percentage of broken cells is approximately 90% or greater, the broken cell debris is separated from the glass beads by centrifugation, and the glass beads are washed with Buffer A. After combining the washes and homogenate, the insoluble material in the lysate is obtained by centrifugation. The material in the pellet is washed to remove soluble proteins by suspension in Buffer B (50 mM glycine, pH 12.0, 1 mM DTT, 500 mM NaCl), followed by Buffer C (50 mM glycine, pH 10.0, 1 mM DTT). The insoluble material is recovered by centrifugation, and solubilized by suspension in Buffer C containing SDS. The extract solution may be heated in the presence of b-mercaptoethanol and concentrated by ultrafiltration. The HCV c100-3 in the extract is precipitated with cold acetone. If desired, the precipitate may be stored at temperatures at about or below −15° C.

Prior to ion exchange chromatography, the acetone precipitated material is recovered by centrifugation, and may be dried under nitrogen. The precipitate is suspended in Buffer D (50 mM glycine, pH 10.0, 1 mM DTT, 7 M urea), and centrifuged to pellet insoluble material. The supernatant material is applied to an anion exchange column previously equilibrated with Buffer D. Fractions are collected and analyzed by ultraviolet absorbance or gel electrophoresis on SDS polyacrylamide gels. Those fractions containing the HCV c100-3 polypeptide are pooled. In order to purify the HCV c100-3 polypeptide by gel filtration, the pooled fractions from the ion-exchange column are heated in the presence of b-mercaptoethanol and SDS, and the eluate is concentrated by ultrafiltration. The concentrate is applied to a gel filtration column previously equilibrated with Buffer E (20 mM Tris HCl, pH 7.0, 1 mM DTT, 0.1% SDS). The presence of HCV c100-3 in the eluted fractions, as well as the presence of impurities, are determined by gel electrophoresis on polyacrylamide gels in the presence of SDS and visualization of the polypeptides. Those fractions containing purified HCV c100-3 are pooled. Fractions high in HCV c100-3 may be further purified by repeating the gel filtration process. If the removal of particulate material is desired, the HCV c100-3 containing material may be filtered through a 0.22 mm filter.

IV.B.7.b. Expression and Purification of Fusion Polypeptide C100-3 (Alternate Method 2)

The fusion polypeptide C100-3 (also called HCV c100-3), is expressed in yeast strain JSC308 transformed with pAB24C100-3. The expression of the C100-3 coding region is under control of the ADH2 upstream activator sequences (UAS) and GAP promoter sequences. This system is repressed when glucose is present in the medium. In the fermentation process, the inocula cultures (Inoculum 1 and 2) are prepared in selective medium containing a high amount of glucose to repress synthesis of the C100-3 polypeptide. Inoculum 2 is then diluted into complete medium containing an initial concentration of glucose sufficient to allow substantial mass increase before being metabolically exhausted by fermentation growth of the culture. After the glucose has been exhausted from this expression medium, the cells derepress the ADH-2 regulated system as they begin to grow by respiration. In this method, the majority of the mass increase of the cell culture is functionally uncoupled from the production of the HCV C100-3 polypeptide. The expressed C100-3 polypeptide thus expressed is purified by isolation of an insoluble cell fraction, extraction of this fraction with SDS followed by acetone precipitation, solubilization of the acetone precipitate, followed by chromatography on an ion exchange column, Q-Sepharose® (Pharmacia), and on gel filtration columns.

Preparation and isolation of transformants is as follows. Yeast strain JSC308 (MATa, ura3-delta 1, leu2-04 [cir°],::DM15 (G418$^R$) is transformed with plasmid pAB24-c100-3, using the lithium transformation procedure described by Ito et al. (1984). The transformation mix is plated onto selective ura$^-$ agar plates, and the plates are incubated at 30° C. for 2 to 4 days. Next, transformants having high plasmid copy numbers are selected by streaking ura$^+$ colonies to leucine selective plates. Transformants are selected on their ability to express the C100-3 polypeptide, as described below.

In order to test expression of C100-3, single transformant colonies are transferred into leu$^-$, 2% glucose medium and grown at 30° C. until saturation. Under these conditions, expression of C100-3 is repressed due to the high glucose concentration in the medium. Expression is induced by a ¹⁄₂₅ dilution of the saturated culture into YEP/1% glucose; the diluted cells are grown to saturation. The cells are harvested, lysed by grinding with glass beads in TE buffer containing NaCl. The insoluble fractions are collected by centrifugation, and solubilized by resuspension in SDS sample buffer and boiling. The solubilized fraction is examined by fractionation on standard 10% denaturing acrylamide gels (Laemmli (1970)). The polypeptides on the gel are visualized by staining with Coomassie blue. Evidence of expression is initially determined by appearance of a new polypeptide in extracts of transformants harboring pAB24-c100-3 as compared with control extracts (cells transformed with pAB24 vector lacking the C100-3 coding region). A protein band of about 53 Kd was clearly seen in extracts of cells harboring the C100-3 expression plasmid; this band was absent from the control extract.

A stock is prepared from a single transformant colony by streaking onto a leu$^-$ selective agar plate, and incubating at 30° C. for 1–4 days. Single colonies are picked, and individually inoculated into about 5 mL of leu$^-$, 2% glucose medium, and grown to saturation at 30° C. One mL is aseptically removed from each tube, and is transferred to a flask containing 500 mL of leu$^-$ medium, 2% glucose. The flask is incubated at 30° C. with agitation, for approximately 29 hours, after which time the flask is removed from incubation, an O.D. 650 value is determined, and the viability of the sample is determined. If the sample is viable, glycerol is added to a final concentration of 15%, and the sample is stored in 1 mL aliquots at $\leq$60° C.

A working seed stock is prepared. An aliquot of the frozen stock is plated onto leu$^-$ selective plates. An isolated small colony is picked, inoculated into 1–5 mL of selective culture (described above), and incubated at 30° C. for one day. One mL from this culture is used to inoculate a larger leu$^-$ selective media culture (500–1000 mL). After 30–60 hours of incubation, the $OD_{650}$ value and viability is determined. Glycerol is added to a final concentration of 15% to the viable culture. The culture is stored at $\leq$60° C. in 1 mL aliquots.

The stocks of transformed cells are analyzed. Viability of the stocks is equal to or greater than 5×10$^5$ viable cells per mL of culture. Phenotypic analysis is for the chromosomal markers MATa and ::DM 15(G418$^R$). MATa is tested by a plate assay that detects secretion of mating factor when the test cells are patched onto a lawn of cells carrying the opposite mating type. Opposite mating types of the lawn and patched cells produce a clear halo around the patch. DM15 (G418$^R$) is tested by patching cells onto YEPD plates with and without geneticin. The presence of the latter marker allows for growth of the cells in geneticin plates.

The plasmids from the cells are also analyzed by restriction map and nucleotide sequence confirmation for the expression cassette.

In order to prepare inoculum 1, the transformed yeast cells from the working stock are incubated in sterile selective medium (leu$^-$, 2% glucose); incubation is at 30±2° C. at 250–350 rpm for 30 to 36 hours.

In order to prepare inoculum 2, sterile selective medium at pH 5.9±0.1 containing approximately 10 g of yeast nitrogen base without amino acids (DIFCO) per liter, 0.5 g of Leu$^-$ supplements per liter, antifoam (approximately 0.1 mL/L), and 200 g of dextrose per liter, is prepared in a fermentor. Inoculum 1 is transferred aseptically to the fermentor, and is incubated at 30±2° C. at an agitation speed of 400±50 rpm with an air flow of 10±2 liters per minute. Incubation is for 24±6 hours.

Expression of C100-3 is accomplished by transferring inoculum 2 to a fresh batch of sterile YEP medium with 2% dextrose, and incubating the cells in a fermentor for 53±7 hours at 30±2° C., with an agitation speed of 200±20 rpm and an air flow 200±20 liters per minute. After the incubation, the fermentor culture is cooled to <20° C., and harvested by continuous flow centrifugation. The supernatant is discarded, and the yeast slurry is collected.

The C100-3 polypeptide is partially purified by removal of the soluble yeast fraction. The yeast slurry is adjusted to 50 mM Tris HCl (using 1.0 M Tris HCl, pH 8.0), 0.15 M NaCl, 2 mM EDTA, and 1 mM PMSF. The yeast is mechanically disrupted using a continuous flow Dynomill glass bead mill with 0.5 mm nominal diameter glass beads. Breakage is continued until >90% of the yeast cells are broken. The resulting lysate is then diluted to achieve a 10% (v/v) solids concentration based on pre-lysis volume and packed cell volume by adding the same lysis buffer containing PMSF. Gross cellular debris is removed by continuous flow centrifugation in a Westfalia Model SA-1 centrifuge, and is discarded. The partially clarified, diluted lysate is further centrifuged at a higher relative G-force to recover the C100-3 polypeptide. This step is accomplished by continuous centrifugation of the lysate in a CEPA LE centrifuge at full speed (flow rate, 100 to 200±20 mL/minute). The supernatant is discarded, and the CEPA pellets are collected and stored at ≦60° C.

Further purification of the C100-3 polypeptide from the CEPA pelleted material is accomplished by acetone precipitation of an SDS solubilized fraction, followed by ion-exchange chromatography of the precipitated material, and then by gel filtration chromatography of the eluate from the ion-exchange column.

The CEPA pelleted material is resuspended in a Tris/EDTA buffer (20 mM Tris HCL, pH 8.0, 1.0 mM EDTA, 1.0 mM PMSF), and insoluble material is collected by centrifugation at 17,000×G for 60 minutes at approximately 4° C. The pellet is washed twice with a glycine/DTT/NaCl buffer (50 mM glycine, 1.0 mM DTT, 50 mM NaCl, pH 12) and once with glycine/DTT buffer (50 mM glycine, 1.0 mM DTT, pH 10.0) before it is extracted by suspension in the same buffer containing 0.5% SDS (w/v). The pellet is recovered by centrifugation (17,000×g, 30 min, about 4° C.), and the SDS extraction is repeated. The two extracts are combined, and heated to 80–85° C. to solubilize the C100-3 polypeptide. After solubilization, the extract is cooled and BME is added to a concentration of 1% (w/v), and the extract solution is precipitated with cold acetone to remove excess SDS; this material may be stored at <−15° C. for up to five weeks. The acetone precipitate is recovered by centrifugation (5,000×g).

In order to further purify the material in the acetone precipitate by chromatography, the precipitate is suspended in glycine/urea buffer (50 mM glycine, pH 10, 7 mM urea, 10 mM DTT), is heated to 80–85° C., then cooled. The extract is then applied to a Q-Sepharose® anion exchange column (2.5 L Q Sepharose®, 25 cm diameter column) which was previously equilibrated against the glycine/urea buffer; the flow rate is ~50 mL per minute, and the temperature is 2 to 8° C. The fractions are collected, and those containing C100-3 polypeptide, as determined by absorbance at 280 nm, are pooled.

The material which passes through the ion exchange column is further purified by gel filtration. The pool of fractions from the ion-exchange column is adjusted to 0.5% (w/v) SDS, and is concentrated two-fold with an ultrafiltration unit using a 30K molecular weight cut-off membrane. The concentrated fraction is then adjusted to 2% (v/v) BME, heated, the protein concentration is measured, and the fraction is cooled. The cooled eluate is then applied to Sephacryl® S-300 HR gel filtration columns which were previously equilibrated with an SDS/Tris buffer (0.1% SDS (w/v), 20 mM Tris HCl, pH 7.0, 10 mM DTT). The gel filtration columns are 55 cm high by 25 cm diameter; the filtration is over two of these units in series; the operating flow is 100 mL per minute. Fraction collection is started immediately after loading. The eluted fractions are analyzed by electrophoresis on polyacrylamide gels containing SDS, in order to determine which of the fractions should be pooled. Prior to electrophoresis, the test samples and a reference sample are prepared by boiling in a buffer containing BME and SDS. Following electrophoresis, the gels are stained with Coomassie blue for visualization of the protein bands. The determination of which fractions to pool is based on the following analysis. The fraction containing the highest and purest amount of polypeptide is called "peak fraction". This fraction together with fractions which elute earlier are pooled up to, and including the first fraction exhibiting a decrease of approximately ⅓ the amount of C100-3 polypeptide band relative to the adjacent fraction, and a decrease of approximately ⅔ relative to the peak fraction. The decrease is observed in the relative thickness of the C100-3 bands. Fractions which elute later than the C100-3 peak are pooled up to, but not including the first fraction exhibiting a visible band at the molecular weight of about 18,000 relative to a molecular weight marker, and including the last fraction exhibiting a decrease of approximately ⅔ of the polypeptide band relative to the peak fraction.

The pooled fractions are further purified by repeating the gel filtration process. The fractions from the second gel filtration column are analyzed as described above, and are further analyzed by HPLC to determine pooling. Analysis by HPLC uses a TSK-400 gel filtration HPLC column, equipped with a computerized integrator. All samples are prepared in a buffer containing 20 mM DTT to prevent oxidation of the C100-3 polypeptide. Pooling based on HPLC analysis is as follows. Using the HPLC chromatograms, the ratio of peak height to peak area for the C100-3 peak in each of the fractions is calculated. The ratio values follow a trend, increasing to a maximum value and then decreasing. Those fractions with a ratio equal to or greater than 85% of the maximum value and which meet the criteria in gel electrophoresis are pooled. The total volume of the pool of fractions is measured, the protein concentration is determined by the Lowry method, and the concentration of the final pool is adjusted to 0.5 to 1.0 mg/mL with the same buffer used for the gel filtration columns.

IV.B.8. Expression and Antigenicity of Polypeptides Encoded in HCV cDNA

IV.B.8.a. Polypeptides Expressed in *E. coli*

Figure 63:
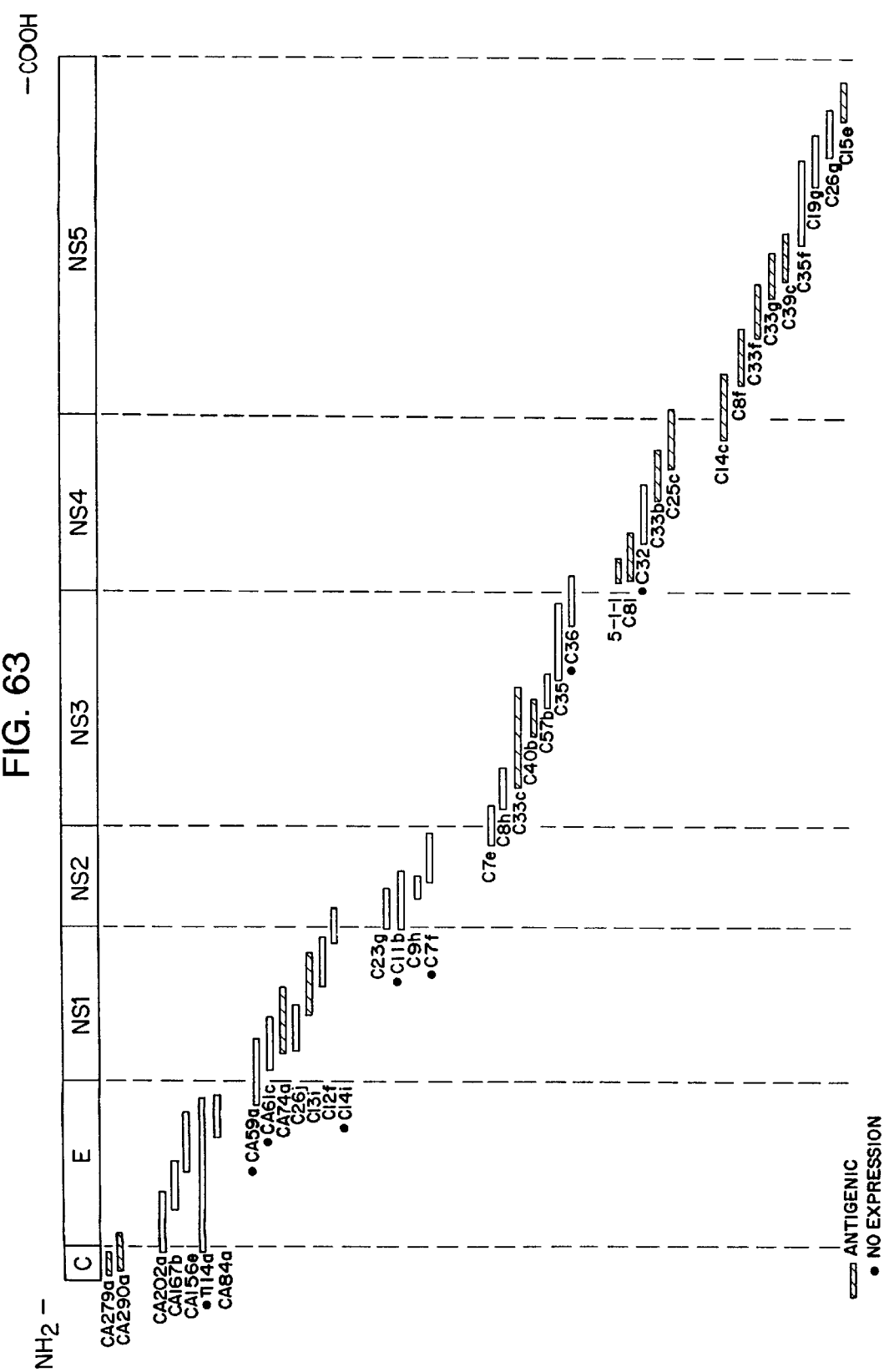
FIG. 63 shows the relative positions of the clones from which HCV cDNA was isolated for expression and antigenic mapping of the putative HCV polyprotein.

The polypeptides encoded in a number of HCV cDNAs which span the HCV genomic ORF were expressed in *E. coli*, and tested for their antigenicity using serum obtained from a variety of individuals with NANBH. The clones from which the HCV cDNAs were isolated, as well as their relative relationships, and antigenicity, are shown in FIG. 63. Also indicated in the figure are the putative polypeptides encoded in the ORF of the HCV genome, based upon the Flavivirus model and the hydropathic character of the putative encoded polypeptides. However, the hydrophobicity profiles (described infra), indicate that HCV diverges from the Flavivirus model, particularly with respect to the region upstream of NS2. Moreover, the boundaries indicated are not intended to show firm demarcations between the putative polypeptides.

Possible protein domains of the encoded HCV polyprotein, as well as the approximate boundaries, are the following:

| Putative Domain | Approximate Boundary (amino acid nos.) |
| --- | --- |
| C(nucleocapsid protein) | 1–120 |
| E(Virion envelope protein(s) and possible matrix (M) proteins | 120–400 |
| NS1(complement fixation antigen?) | 400–660 |
| NS2(unknown function) | 660–1050 |
| NS3(protease?) | 1050–1640 |
| NS4(unknown fuction) | 1640–2000 |
| NS5(polymerase) | 2000–? end |

These domains are, however, extremely tentative, since they are based upon the Flavivirus model, and recent evidence suggests that the relationship between HCV and the flaviviridae may be distant.

The expression vectors containing the cloned HCV cDNAs were constructed from pSODcf1, which is described in Section IV.B.1. In order to be certain that a correct reading frame would be achieved, three separate expression vectors, pcf1AB, pcf1CD, and pcf1EF were created by ligating three new linkers, AB, CD, and EF to a BamHI-EcoRI fragment derived by digesting to completion the vector pSODcf1 with EcoRI and BamHI, followed by treatment with alkaline phosphatase. The linkers were created from six oligomers, A, B, C, D, E, and F. Each oligomer was phosphorylated by treatment with kinase in the presence of ATP prior to annealing to its complementary oligomer. The sequences of the synthetic linkers were the following.

| Name | DNA Sequence(5' to 3') | |
| --- | --- | --- |
| A | GATC CTG AAT TCC TGA TAA | (SEQ ID NO:231) |
| B | GAC TTA AGG ACT ATT TTA A | (SEQ ID NO:232) |
| C | GATC CGA ATT CTG TGA TAA | (SEQ ID NO:233) |
| D | GCT TAA GAC ACT ATT TTA A | (SEQ ID NO:234) |
| E | GATC CTG GAA TTC TGA TAA | (SEQ ID NO:235) |
| F | GAC CTT AAG ACT ATT TTA A | (SEQ ID NO:236) |

Each of the three linkers destroys the original EcoRI site, and creates a new EcoRI site within the linker, but within a different reading frame. Hence, the HCV cDNA EcoRI fragments isolated from the clones when inserted into the expression vector, were in three different reading frames.

The HCV cDNA fragments in the designated λgt11 clones (indicated in FIG. 63) were excised by digestion with EcoRI; each fragment was inserted into pcf1AB, pcf1CD, and pcf1EF. These expression constructs were then transformed into D1210 *E. coli* cells, the transformants were cloned, and polypeptides were expressed as described in Section IV.B.2.

Figure 64:
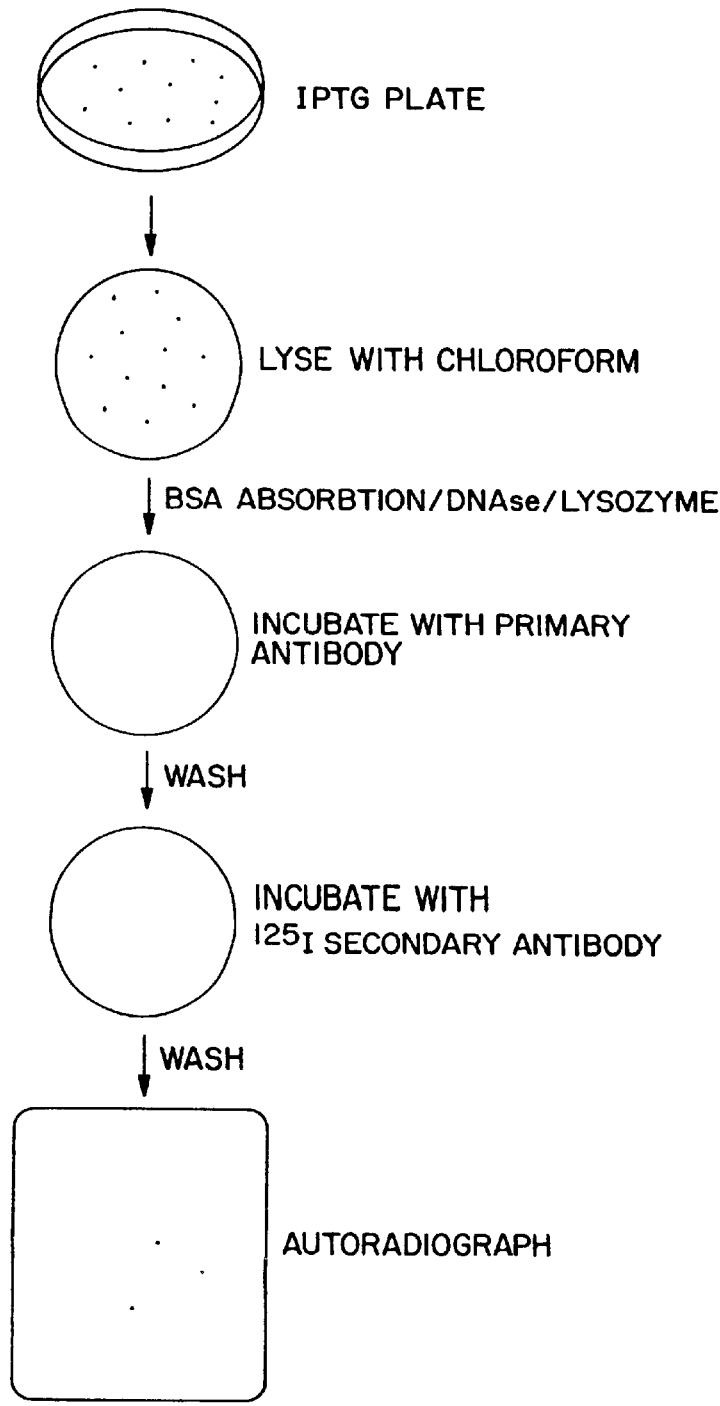
FIG. 64 is a diagram of the immunological colony screening method used in antigenic mapping studies.

Expression products of the indicated HCV cDNAs were tested for antigenicity by direct immunological screening of the colonies, using a modification of the method described in Helfman et al. (1983). Briefly, as shown in FIG. 64, the bacteria were plated onto nitrocellulose filters overlaid on ampicillin plates to give approximately 1,000 colonies per filter. Colonies were replica plated onto nitrocellulose filters, and the replicas were regrown overnight in the presence of 2 mM IPTG and ampicillin. The bacterial colonies were lysed by suspending the nitrocellulose filters for about 15 to 20 min in an atmosphere saturated with $CHCl_3$ vapor. Each filter then was placed in an individual 100 mm Petri dish containing 10 mL of 50 mM Tris HCl, pH 7.5, 150 mM NaCl, 5 mM $MgCl_2$, 3% (w/v) BSA, 40 mg/mL lysozyme, and 0.1 mg/mL DNase. The plates were agitated gently for at least 8 hours at room temperature. The filters were rinsed in TBST (50 mM Tris HCl, pH8.0, 150 mM NaCl, 0.005% Tween® 20). After incubation, the cell residues were rinsed and incubated in TBS (TBST without Tween®) containing 10% sheep serum; incubation was for 1 hour. The filters were then incubated with pretreated sera in TBS from individuals with NANBH, which included: 3 chimpanzees; 8 patients with chronic NANBH whose sera were positive with respect to antibodies to HCV C100-3 polypeptide (described in Sections IV.B.6. and IV.B.7.) (also called C100); 8 patients with chronic NANBH whose sera were negative for anti-C100 antibodies; a convalescent patient whose serum was negative for anti-C100 antibodies; and 6 patients with community acquired NANBH, including one whose sera was strongly positive with respect to anti-C100 antibodies, and one whose sera was marginally positive with respect to anti-C100 antibodies. The sera, diluted in TBS, was pretreated by preabsorption with hSOD. Incubation of the filters with the sera was for at least two hours. After incubation, the filters were washed two times for 30 min with TBST. Labeling of expressed proteins to which antibodies in the sera bound was accomplished by incubation for 2 hours with $^{125}I$-labeled sheep anti-human antibody. After washing, the filters were washed twice for 30 min with TBST, dried, and autoradiographed.

As seen from the results shown in FIG. 65, a number of clones expressed polypeptides containing HCV epitopes which were immunologically reactive with serum from individuals with NANBH. Five of these polypeptides were very immunogenic in that antibodies to HCV epitopes in these polypeptides were detected in many different patient sera. The clones encoding these polypeptides, and the location of the polypeptide in the putative HCV polyprotein (wherein the amino acid numbers begin with the putative initiator codon) are the following: clone 5-1-1, amino acids 1694–1735; clone C100, amino acids 1569–1931; clone 33c, amino acids 1192–1457; clone CA279a, amino acids 1–84; and clone CA290a amino acids 9–177. The location of the immunogenic polypeptides within the putative HCV polyprotein are shown immediately below.

Clones Encoding Polypeptides of Proven Reactivity with Sera from NANBH Patients

| Clone | Location within the HCV polyprotein (amino acid no. beginning with putative initiator methionine) |
| --- | --- |
| CA279a | 1–84 |
| CA74a | 436–582 |
| 13i | 511–690 |
| CA290a | 9–177 |
| 33c | 1192–1457 |
| 40b | 1266–1428 |
| 5-1-1 | 1694–1735 |
| 81 | 1689–1805 |
| 33b | 1916–2021 |
| 25dc | 1949–2124 |
| 14c | 2054–2223 |
| 8f | 2200–3325 |
| 33f | 2287–2385 |
| 33g | 2348–2464 |
| 39c | 2371–2502 |
| 15e | 2796–2886 |
| C100 | 1569–1931 |

The results on the immunogenicity of the polypeptides encoded in the various clones examined suggest efficient detection and immunization systems may include panels of HCV polypeptides/epitopes.

IV.B.8.b. Expression of HCV Epitopes in Yeast

Three different yeast expression vectors which allow the insertion of HCV cDNA into three different reading frames are constructed. The construction of one of the vectors is described in Section IV.B.4., except that HCV cDNA from the clones listed in Section IV.B.8.a. are substituted for the C100 HCV cDNA. The construction of the other vectors replaces the adaptor described in Section IV.B.4. with one of the following adapters:

Adaptor 1

ATT TTG AAT TCC TAA TGA G

AC TTA AGG ATT ACT CAG CT        (SEQ ID NO:237)

Adaptor 2

AAT TTG GAA TTC TAA TGA G

AC CTT AAG ATT ACT CAG CT.        (SEQ ID NO:238)

The inserted HCV cDNA is expressed in yeast transformed with the vectors, using the expression conditions described in Section IV.B.4. The resulting polypeptides are screened using the sera from individuals with NANBH, described in Section IV.B.8.a.

IV.B.9. Expression and Purification of Fusion Polypeptide SOD-C33c

A fusion polypeptide comprised of SOD at the N-terminus and in-frame C33c HCV-polypeptide at the C-terminus (SOD-C33c), is encoded in clone pCF1EF/C33c (see Section IV.B.8.). This polypeptide was expressed in *E. coli*, and purified therefrom.

Expression was accomplished by inoculating 1500 mL of Luria broth containing ampicillin (100 mg/mL) with 15 mL of an overnight culture of *E. coli* D1210 transformed with clone pCF1EF/C33c. The cells were grown to an O.D. of 0.3, IPTG was added to yield a final concentration of 2 mM, and growth continued until the cells attained a density of 1 O.D., at which time they were harvested by centrifugation at 3,000×g at 4° C. for 20 minutes. The packed cells can be stored at −80° C. for several months.

In order to purify the SOD-C33c polypeptide the bacterial cells in which the polypeptide was expressed were subjected to osmotic shock and mechanical disruption, the insoluble fraction containing SOD-C33c was isolated and subjected to differential extraction with an alkaline-NaCl solution, and the fusion polypeptide in the extract purified by chromatography on a cation exchange column, S-Sepharose® (Pharmacia) and an anion exchange column, Q-Sepharose® (Pharmacia).

The crude extract resulting from osmotic shock and mechanical disruption was prepared by the following procedure. One gram of the packed cells were suspended in 10 mL of a solution containing 0.02 M Tris HCl, pH 7.5, 10 mM EDTA, 20% sucrose, and incubated for 10 minutes on ice. The cells were then pelleted by centrifugation at 4,000×g for 15 min at 4° C. After the supernatant was removed, the cell pellets were resuspended in 10 mL of Buffer A1 (0.01 M Tris HCl, pH 7.5, 1 mM EDTA, 14 mM b-mercaptoethanol [BME]), and incubated on ice for 10 minutes. The cells were again pelleted at 4,000×g for 15 minutes at 4° C. After removal of the clear supernatant (periplasmic fraction I), the cell pellets were resuspended in Buffer A1, incubated on ice for 10 minutes, and again centrifuged at 4,000×g for 15 minutes at 4° C. The clear supernatant (periplasmic fraction II) was removed, and the cell pellet resuspended in 5 mL of Buffer A2 (0.02 M Tris HCl, pH 7.5, 14 mM BME, 1 mM EDTA, 1 mM PMSF). In order to disrupt the cells, the suspension (5 mL) and 7.5 mL of Dyno-mill lead-free acid washed glass beads (0.10–0.15 mm diameter)(obtained from Glen-Mills, Inc.) were placed in a Falcon tube, and vortexed at top speed for two minutes, followed by cooling for at least 2 min on ice; the vortexing-cooling procedure was repeated another four times. After vortexing, the slurry was filtered through a scintered glass funnel using low suction; the glass beads were washed two times with Buffer A2, and the filtrate and washes combined.

The insoluble fraction of the crude extract was collected by centrifugation at 20,000×g for 15 min at 4° C., washed twice with 10 mL Buffer A2, and resuspended in 5 mL of MILLI-Q water.

A fraction containing SOD-C33c was isolated from the insoluble material by adding to the suspension NaOH (2 M) and NaCl (2 M) to yield a final concentration of 20 mM each, vortexing the mixture for 1 minute, centrifuging it 20,000×g for 20 min at 4° C., and retaining the supernatant.

In order to purify SOD-C33c on a cation exchange column, S-Sepharose® (Pharmacia), the supernatant fraction was adjusted to a final concentration of 6M urea, 0.05M Tris HCl, pH 7.5, 14 mM BME, 1 mM EDTA. This fraction was then applied to a cation exchange column, S-Sepharose Fast Flow® (Pharmacia) (1.5×10 cm) which had been equilibrated with Buffer B (0.05M Tris HCl, pH 7.5, 14 mM BME, 1 mM EDTA). After application, the column was washed with two column volumes of Buffer B. The flow through and wash fractions were collected. The flow rate of application and wash, was 1 mL/min; and collected fractions were 1 mL. In order to identify fractions containing SOD-C33c, aliquots of the fractions were analyzed by electrophoresis on 10% polyacrylamide gels containing SDS followed by staining with Coomassie blue. The fractions are also analyzable by Western blots using an antibody directed against SOD. Fractions containing SOD-C33c were pooled.

Further purification of SOD-C33c was on an anion exchange column, Q-Sepharose column® (Pharmacia) (1.5×5 cm) which was equilibrated with Buffer B. The pooled fractions containing SOD-C33c obtained from chromatography on a cation exchange column, S-Sepharose® (Pharmacia) was applied to the column. The column was then washed with Buffer B, and eluted with 60 mL of a gradient of 0.0 to 0.4 M NaCl in Buffer B. The flow rate for application, wash, and elution was 1 mL/min; collected fractions were 1 mL. All fractions from the anion exchange column, Q-Sepharose® (Pharmacia) were analyzed as described for the cation exchange column, S-Sepharose® (Pharmacia). The peak of SOD-C33c eluted from the column at about 0.2 M NaCl.

The SOD-C33c obtained from the anion exchange column, Q-Sepharose® (Pharmacia) was greater than about 90% pure, as judged by analysis on the polyacrylamide SDS gels and immunoblot using a monoclonal antibody directed against human SOD.

IV.B.10. Expression in Yeast of Fusion Polypeptide SOD-C200-C100

IV.B.10.a. Construction of an Expression Vector Comprised of Expression Cassette C200-C100

An expression cassette containing the ADH2/GAP promoter, a sequence encoding SOD, the composite HCV sequences C200 and C100, and the a-factor terminator was constructed. The C200 sequence overlaps the C100 sequence. Thus, the C200-C100 construct was designed to express the segment of the continuous ORF contained in clones 33c/31/35/36/81/32. FIG. 79 shows the sequence of the HCV cDNA in the construct, the polypeptides encoded therein, and the putative restriction enzyme sites encoded therein.

The C200-C100 construct was formed by ligating together a ~1.29 Kbp fragment obtained by digestion of plasmid pBR322-C200 with EcoRI and NcoI, and a ~950 bp fragment obtained by digestion of plasmid pS3-56$_{C100m}$ with NcoI and SalI. The construction of plasmids pBR322-C200 and of pS$^3$-56$_{C100\,m}$ are described in Sections IV.A.37 and IV.A.36, respectively.

In order to join the ADH2/GAP promoter, and the sequence encoding SOD to the 5'-terminus of the construct, and the α-factor terminator to the 3'-terminus of the construct, the C200-C100 construct was inserted into the vector pS3-34, which had been digested with EcoRI and SalI.

The vector pS3-34 was created from the vector pYSI3 by deletion of the insulin sequences encoded therein, and by insertion of two linkers, C and D. These linkers allow the SOD encoding sequence and the HCV C200-C100 sequences to be in correct reading frame. Deletion of the insulin sequences was accomplished by digestion with EcoRI and SalI, followed by purification of the large vector fragment. The sequences of the inserted linkers are:

Linker C: 5' AAT TTG GAA TTC TAA TTA ATT AAG 3'

Linker D: AC <u>CTT AAG</u> ATT AAT TAA
TT<u>CAGCT</u>   (SEQ ID NO:239 and SEQ ID NO:240)

The underlined sequences, CTTAAG and CAGCT, indicate an EcoRI site and a SalI site, respectively.

The plasmid pYSI3, described briefly in Table 1 of the U.S. Pat. No. 4,751,180, was used as a convenient way to attach the C100 and C200-C100m sequences to the ADH2/GAP hybrid promoter, the α-factor terminator and the SOD sequences. Previously, pYSI3 was used to express insulin; therefore, the vector contains a BamHI cassette (2.4 Kbp) which comprises the ADH2/GAP hybrid yeast promoter upstream of the hSOD gene (see U.S. Pat. No. 4,751,180) which in turn is fused to a hinge region and an insulin gene. Downstream of the insulin sequence is the yeast α-factor transcription terminator which is a 270 bp, SalI to EcoRI fragment, from the *Saccharomyces cerevisiae* α-factor gene described in Singh et al., *Nuc Acids Res* (1983) 11(12):4049–4063. The insulin and hinge sequences were removed from the vector by digestion with EcoRI and SalI and the appropriate synthetic adapters were inserted between these two restriction sites to yield plasmid pS3-56 and pS3-34.

An expression vector containing the C200-C100 expression cassette was constructed by insertion of the cassette into the yeast expression vector pAB24; the vector pAB24 is described in Section IV.B.4. The insertion was accomplished by excising a 4349 bp BamHI/BamHI cassette from the pS3-34/C200-C100 cloning vector and inserting the fragment into the BamHI site of the expression vector pAB24. The resulting vector, which is called pAB24/C200-C100, was transformed into yeast strain JSC308. Yeast strain JSC308 is described in commonly owned U.S. Ser. No. 190,868, and is on deposit with the American Type Culture Collection under Accession No. 20879.

IV.B.10.b. Expression of Fusion Polypeptide SOD/C200-C100

Expression of fusion polypeptide SOD/C200-C100 encoded in pAB24/C200-C100 was in yeast strain JSC308, which had been transformed with the isolated expression vector. The yeast transformants were grown in an inoculum culture for 24 to 30 hours in Leu⁻ medium containing 2% glucose; growth was at 30° C. at an agitation rate of 300 rpm. Expression of the fusion polypeptide was obtained by inoculating 500 mL of YEP containing 2% glucose with 25 mL of the inoculum culture, followed by incubation at 30° C. for 48 hours at an agitation rate of about 300 rpm. Growth was in a 2.8 L Fernbach flask.

Alternatively, 500 mL of inoculum was added to 10 L of YEP containing 4% glucose, and growth was in a Braun Biotech Model Biostat E fermentor at an agitation rate of about 400±20 rpm at a temperature of about 30° C.±2° C. and an air flow rate of 10±slpm; the cells were harvested 50 hours after inoculation.

IV.B.11. Expression of HCV Polypeptide C100 in Yeast

The composite HCV cDNA C100 (see Section IV.A.16) was fused directly to the ADH2/GAP promoter, and expressed in yeast.

IV.B.11.a. Construction of Yeast Expression Vector pC100-d#3

Figure 76:
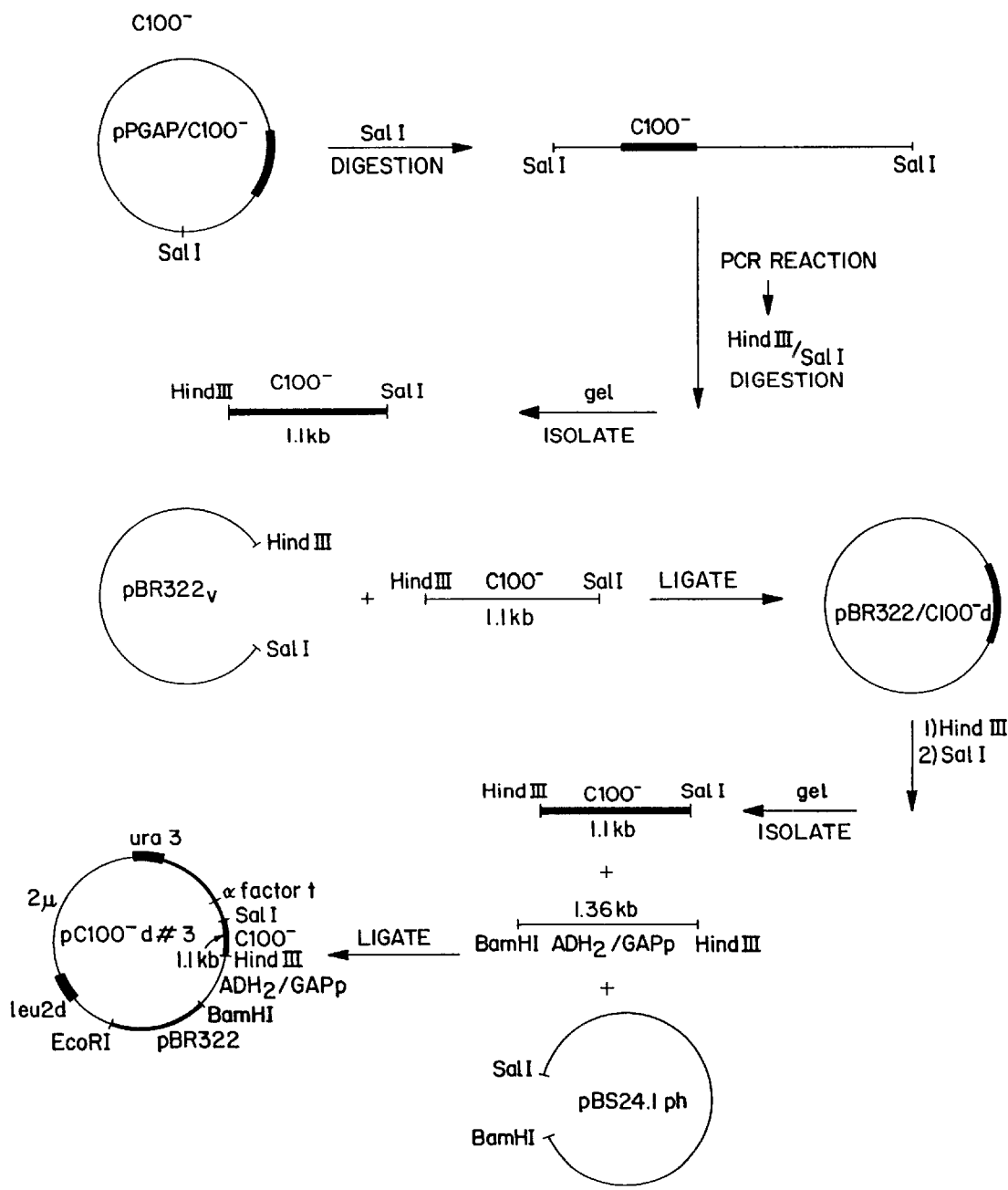
FIG. 76 shows a flow chart for construction of the expression vector pC100-d#3.

The construction of a yeast expression vector in which the HCV cDNA C100 sequence (described in Sections IV.A.16.) was fused directly to the ADH2/GAP promoter was accomplished by a protocol which included amplification of the C100 sequence using a PCR method, followed by ligation of the amplified sequence into a cloning vector. After cloning, the C100 sequence was excised, and with a sequence which contained the ADH2/GAP promoter, was ligated to a large fragment of a yeast vector to yield a yeast expression vector. A flow chart of the construction of the yeast expression vector is shown in FIG. 76.

The PCR amplification of C100 was performed using as template the vector pS3-56$_{C100m}$ (see Section IV.A.36.), which had been linearized by digestion with SalI.

The oligonucleotide primers used for the amplification were designed to facilitate cloning into the expression vector, and to introduce a translation termination codon. Specifically, novel 5'-HindIII and 3'-SalI sites were generated with the PCR oligonucleotides. The oligonucleotide containing the SalI site also encodes the double termination codons, TAA and TGA. The oligonucleotide containing the HindIII site also contains an untranslated leader sequence derived from the pgap63 gene, situated immediately upstream of the AUG codon. The pEco63GAPDH gene is described by Holland and Holland (1980) and by Kniskern et al. (1986). The PCR primer sequences used for the direct expression of C100m were:

5' GAG TGC TCA AGC TTC AAA ACA AAA TGG CTC
ACT TTC TAT CCC AGA CAA AGC AGA
GT 3'          (SEQ ID NO:241)

and

5' GAG TGC TCG TCG ACT CAT TAG GGG GAA
ACA TGG TTC CCC CGG GAG GCG AA 3' (SEQ ID NO:242).

Amplification by PCR, utilizing the primers, and template, was with a Cetus-Perkin-Elmer PCR kit, and was performed according to the manufacturer's directions. The PCR conditions were 29 cycles of 94° C. for a minute, 37° C. for 2 minutes, 72° C. for 3 minutes; and the final incubation was at 72° C. for 10 minutes. The DNA can be stored at 4° C. or −20° C. overnight.

After amplification, the PCR products were digested with HindIII and SalI. The major product of 1.1 kb was purified by electrophoresis on a gel, and the eluted purified product was ligated with a large SalI-HindIII fragment of pBR322. In order to isolate correct recombinants, competent HB101 cells were transformed with the recombinant vectors, and after cloning, the desired recombinants were identified on the basis of the predicted size of HindIII- SalI fragments excised from the clones. One of the clones which contained the a HindIII-SalI fragment of the correct size was named pBR322/C100-d. Confirmation that this clone contained amplified C100 was by direct sequence analysis of the HindIII-SalI fragment.

The expression vector containing C100 was constructed by ligating the HindIII-SalI fragment from pBR322/C100-d to a 13.1 kb BamHI-SalI fragment of pBS24.1, and a 1369 bm BamHI-HindIII fragment containing the ADH2/GAP promoter. (The latter fragment is described in EPO 164, 556). The pBS24.1 vector is described in commonly owned U.S. Ser. No. 382,805 filed Jul. 19, 1989. The ADH2/GAP promoter fragment was obtained by digestion of the vector pPGAP/AG/HindIII with HindIII and BamHI, followed by purification of the 1369 bp fragment on a gel.

Competent HB101 cells were transformed with the recombinant vectors; and correct recombinants were identified by the generation of a 2464 bp fragment and a 13.1 kb fragment generated by BamHI and SalI digestion of the cloned vectors. One of the cloned correct recombinant vectors was named pC100-d#3.

IV.B.11.b. Expression of C100 from pC100-d#3

In order to express C100, competent cells of *Saccharomyces cerevisiae* strain AB122 (MATa leu2 ura3-53 prb 1-1122 pep4-3 prcl-407[cir-0]) were transformed with the expression vector pC100-d#3. The transformed cells were plated on URA-sorbitol, and individual transformants were then streaked on Leu– plates.

Individual clones were cultured in Leu⁻, ura⁻ medium with 2% glucose at 30° C. for 24–36 hours. One liter of Yeast Extract Peptone Medium (YEP) containing 2% glucose was inoculated with 10 mL of the overnight culture, and the resulting culture was grown at 30° C. at an agitation rate of 400 rpm and an aeration rate of 1 L of air per 1 L of medium per minute (i.e., 1 vvm) for 48 hours. The pH of the medium was not controlled. The culture was grown in a BioFlo II fermentor manufactured by New Brunswick Science Corp. Following fermentation, the cells were isolated and analyzed for C100 expression.

Analysis for expressed C100 polypeptide by the transformed cells was performed on total cell lysates and crude extracts prepared from single yeast colonies obtained from the Leu⁻ plates. The cell lysates and crude extracts were analyzed by electrophoresis on SDS polyacrylamide gels, and by Western blots. The Western blots were probed with rabbit polyclonal antibodies directed against the SOD-C100 polypeptide expressed in yeast. The expected size of the C100 polypeptide is 364 amino acids. By gel analysis the expressed polypeptide has a $MW_r$ of 39.9K.

Both analytical methods demonstrated that the expressed C100 polypeptide was present in total cell lysates, but was absent from crude extracts. These results suggest that the expressed C100 polypeptide may be insoluble.

IV.B.12 Expression of HCV Polypeptide S2 in Yeast

An S2 polypeptide encoded in the HCV cDNA shown in FIG. 72 contains amino acids 199 to 328 encoded in the ORF. The clone, pi14a, described supra, contains an HCV cDNA which encodes these amino acids.

Figure 77:
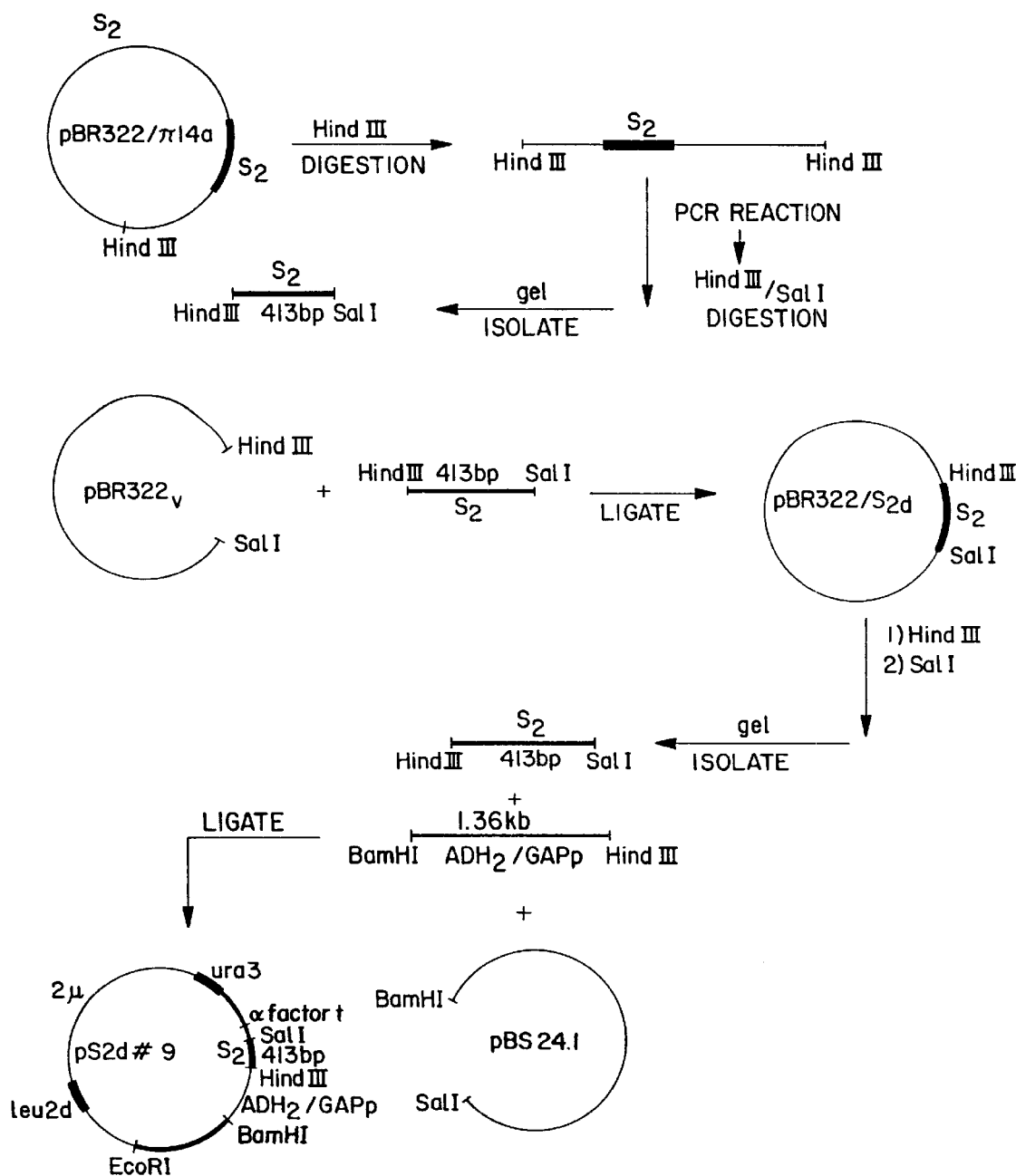
FIG. 77 shows a flow chart for construction of the expression vector pS2d#9.

The protocol for the construction of the expression vector encoding the S2 polypeptide and for its expression in yeast was analogous to that used for the expression of the C100 polypeptide, described in Sections IV.B.11, IV.B.11a and IV.B.11b, except for the following. (A flow chart of the construction of the yeast expression vector encoding S2 is shown in FIG. 77.)

The template for the PCR reaction was the vector pBR322/Pi14a, which had been linearized by digestion with HindIII.

The oligonucleotides used as primers for the amplification by PCR of the S2 encoding sequence were the following.

For the 5'-region of the S2 sequence:

5' GAG TGC TCA AGC TTC AAA ACA AAA TGG GGC TCT ACC ACG TCA CCA ATG ATT GCC CTA
AC 3'                                    (SEQ ID NO:243)

and for the 3'-region of the S2 sequence:

5' GAG TGC TCG TCG ACT CAT TAA GGG GAC CAG TTC ATC ATC ATA TCC CAT GCC AT 3'    (SEQ ID NO:244).

The primer for the 5'-region introduces a HindIII site and an ATG start codon into the amplified product. The primer for the 3'-region introduces translation stop codons and a SalI site into the amplified product.

The PCR conditions were 29 cycles of 94° C. for a minute, 37° C. for 2 minutes, 72° C. for 3 minutes, and the final incubation was at 72° C. for 10 minutes.

The main product of the PCR reaction was a 413 bp fragment, which was gel purified. The purified fragment was ligated to the large fragment obtained from pBR322 digested with HindIII and SalI fragment, yielding the plasmid pBR322/S2d.

Ligation of the 413 bp HindIII-SalI S2 fragment with the 1.36 kb BamHI-HindIII fragment containing the ADH2/GAP promoter, and with the large BamHI-SalI fragment of the yeast vector pBS24.1 yielded recombinant vectors, which were cloned. Correct recombinant vectors were identified by the presence of a 1.77 kb fragment after digestion with BamHI and SalI. An expression vector constructed from the amplified sequence, and containing the sequence encoding S2 fused directly to the ADH2/GAP promoter is identified as pS2d#9.

Analysis for expressed S2 polypeptide by the transformed cells was performed on total cell lysates and crude extracts prepared from single yeast colonies obtained from the Leu⁻ plates. The cell lysates and crude extracts were analyzed by electrophoresis on SDS polyacrylamide gels. The expected size of the S2 polypeptide is 130 amino acids. By gel analysis, the expressed polypeptide has a $MW_r$ of 16 Kd. The expressed S2 was detected in the total lysates, and not in the crude extracts, suggesting that the expressed S2 may be insoluble.

IV.B.13. Expression of HCV C Polypeptide in Yeast

A polypeptide encoded in the HCV cDNA shown in FIG. 72, and which contains amino acids numbers 1 to 122 encoded in the ORF, is named herein the C polypeptide.

The protocol for the construction of the expression vector encoding the C polypeptide and for its expression in yeast was analogous to that used for the expression of the C100 polypeptide, described in Sections IV.B.11, IV.B.11.a and IV.B.11.b, except for the following. (A flow chart of the construction of the yeast expression vector encoding the C polypeptide is shown in FIG. 92.)

The template for the PCR reaction was pBR322/Ag30a which had been linearized with HindIII. The HCV cDNA in clone Ag30a is described in Section IV.A.30. The oligonucleotides used as primers for the amplification by PCR of the C encoding sequence were the following.

For the 5'-region of the C sequence:

5' GAG TGC AGC TTC AAA ACA AAA TGA GCA CGA

ATC CTA AAC CTC AAA AAA AAA AC 3'    (SEQ ID NO:245)

and for the 3'-region of the C sequence:

5' GAG TGC TCG TCG ACT CAT TAA CCC AAA TTG CGC

GAC CTA CGC CGG GGG TCT GT 3'    (SEQ ID NO:246).

The primer for the 5'-region introduces a HindIII site into the amplified product, and the primer for the 3'-region introduces translation stop codons and a SalI site. The PCR was run for 29 cycles of 94° C. for a minute, 37° C. for 2 minutes, 72° C. for 3 minutes, and the final incubation was at 72° C. for 10 minutes.

The major product of PCR amplification is a 381 bp polynucleotide. Ligation of this fragment with the SalI-HindIII large SalI-HindIII fragment of pBR322 yielded the plasmid pBR322/C2.

Ligation of the 381 bp HindIII-SalI C coding fragment excised from pBR322/C2 with the 1.36 kb BamHI-HindIII fragment containing the ADH2/GAP promoter, and with the large BamHI-SalI fragment of the yeast vector pBS24.1 yielded recombinant vectors, which were cloned. Correct recombinant vectors were identified by the presence of a 1.74 kb fragment after digestion with BamHI and SalI. An expression vector constructed from the amplified sequence, and containing the sequence encoding C fused directly to the ADH2/GAP promoter is identified as pC22.

Analysis for expressed C polypeptide by the transformed cells was performed on total cell lysates and crude extracts prepared from single yeast colonies obtained from the Leu⁻ plates. The cell lysates and crude extracts were analyzed by electrophoresis on SDS polyacrylamide gels. The C polypeptide is expected to have 122 amino acids and by gel analysis the expressed polypeptide has a $MW_r$ of approximately 13.6 Kd.

IV.B.14. Expression of a Polypeptide Which Contains Amino Acid Numbers 404–661 of the HCV Polyprotein A polypeptide encoded in the HCV cDNA shown in FIG. 72, and which contains amino acids numbers 404 to 661 encoded in a region of the HCV ORF designated as "x" is named herein the NS1 polypeptide. It should be noted that this designation is not meant to connote that the characteristics of this polypeptide are equivalent to that of the NS1 polypeptide of the flaviviruses, for the reasons discussed supra.

IV.B.14.a. Expression of NS1 in Yeast

Figure 78:
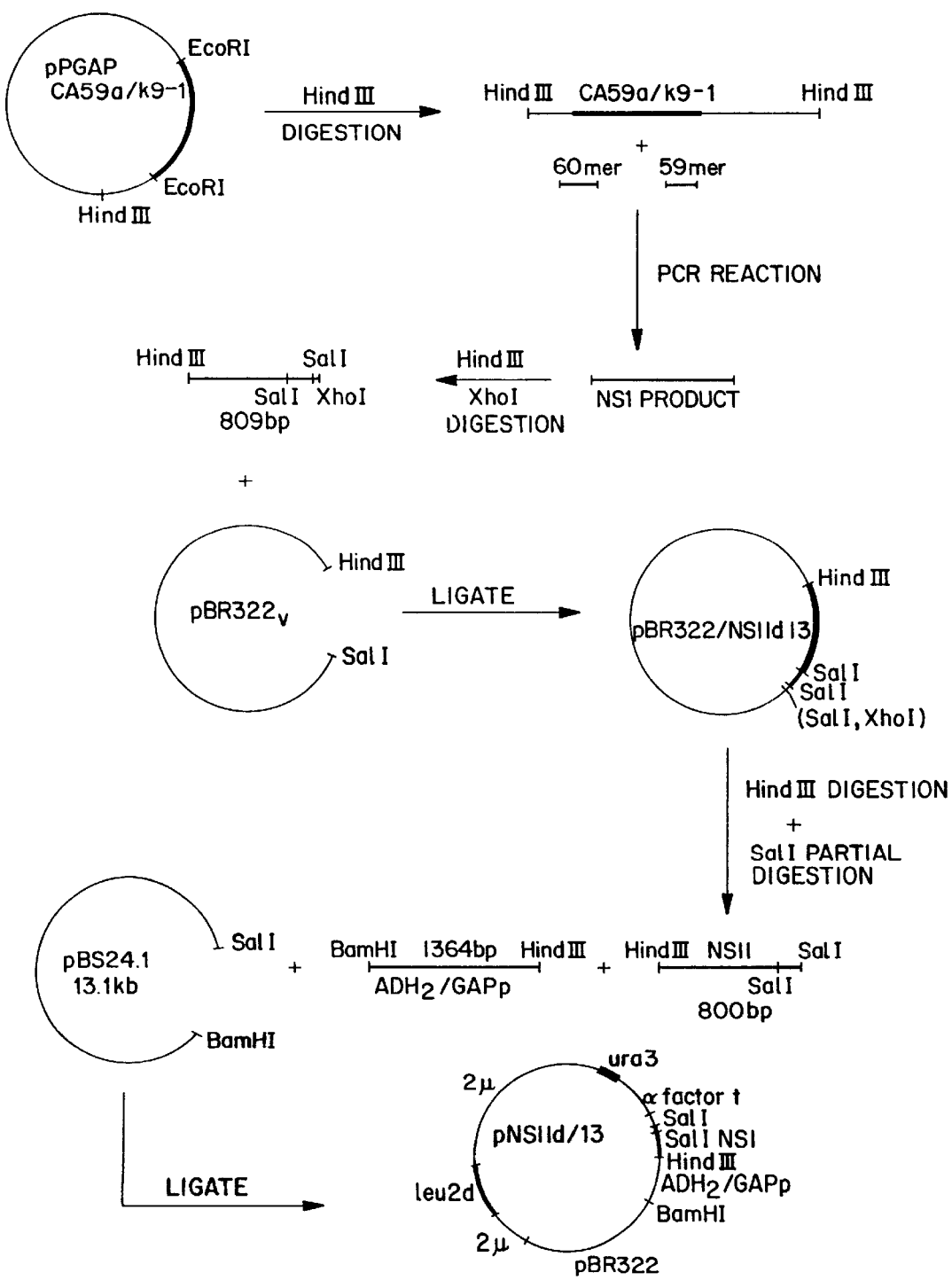
FIG. 78 shows a flow chart for construction of the expression vector pNS11d/13.

The protocol for the construction of the expression vector encoding the NS1 polypeptide and for its expression in yeast was analogous to that used for the expression of the C100 polypeptide, described in Sections IV.B.11, IV.B.11.a, and IV.B.11.b, except for the following. (A flow chart of the construction of the yeast expression vector encoding NS1 is shown in FIG. 78).

The template for the PCR amplification of the NS1 encoding sequence was pBR K-9-1/59a (also called pBR K/9-1/59a), which had been linearized by digestion with HindIII. The clone CA59a, described in Example IV.A.27, was inserted into the EcoRI site of pBR322 and the clone K-9-1, described in Example IV.A.26, was inserted into the BglII site of pPGAP. A PstI to NheI fragment from the pBR322/CA59a vector was ligated to a PstI to NheI fragment from the pPGAP3/K-9-1 to create the vector pBR K-9-1/59a, from which the HCV cDNA can be released by digestion with BglII and EcoRI. The vector pPGAP3 is a PBR322 derivative with the GAP promoter and terminator, described in U.S. patent application Ser. No. 468,589, filed on Feb. 22, 1983.

The oligonucleotides used as primers for PCR amplification of the NS1 coding sequence were designed to not only to generate novel 5' HindIII site, and a 3'-SalI site and double termination codons; in addition, the 3'-oligonucleotide primer also included an XhoI restriction site. The sequences of the oligonucleotide primers is the following.

For the 5'-region of the NS1 sequence:

5' GAG TGC TCA AGC TTA CAA AAC AAA ATG GCA CCA

GGC GCC AAG CAG AAC GTC CAG
    CTG ATC 3'    (SEQ ID NO:247)

and for the 3'-region of the NS1 sequence:

5' GAG TGC TCC TCG AGG TCG ACT CAT TAC TCG GAC

CTG TCC CTA TCT TCC AGA TCG CAA
    CG 3'    (SEQ ID NO:248).

For cloning NS1 into a yeast expression vector, the PCR conditions were 15 cycles of 94° C. for 1.5 minutes, 60° C. for 2 minutes, and 72° C. for 3 minutes. After 15 cycles, the last incubation was at 72° C. for 10 minutes.

After amplification by PCR, the products were digested with HindIII and XhoI, and an 809 bp product isolated after gel electrophoresis. This product was ligated with the large HindIII-SalI fragment of pBR322. (This construction results in the loss of 3'-XhoI site from the NS1 coding sequence, and the SalI site of pBR322). After cloning in HB101, plasmids containing the correct insert were identified by the presence of an 800 bp HindIII-SalI fragment, after digestion of the DNA with HindIII and partial digestion with SalI. A plasmid containing the correct insert was named pBR322/NS11d/13.

An 800 bp fragment which encodes NS1 was excised from pBR322/NS11d/13 by digestion with HindIII and partial digestion with SalI, and was isolated by gel electrophoresis. Ligation of this fragment with the 1.36 kb BamHI-HindIII fragment containing the ADH2/GAP promoter, and with the large BamHI-SalI fragment of the yeast vector pBS24.1 yielded recombinant vectors, which were cloned. Correct recombinant vectors were identified by the liberation of 2008 bp and 165 bp fragments in addition to a 13.1 kb fragment after digestion with HindIII and SalI. A recombinant vector containing the desired insert is named pNS11d/13 (also named pNS11/13-15).

Analysis for expressed NS1 polypeptide by the pNS11d/13 transformed cells was performed on total cell lysates and crude extracts prepared from single yeast colonies obtained from the Leu⁻ plates. The cell lysates and crude extracts were analyzed by electrophoresis on SDS polyacrylamide gels and by Western blots. A human serum sample was identified by the experiment described in Section IV.B.8.a to contain antibodies against the NS1 region. This serum was used as a primary antibody in the Western blotting. The NS1 polypeptide is expected to have 258 amino acids, and by gel analysis the expressed polypeptide has a $MW_r$ of approximately 29 K. Both methods of analysis indicated the presence of expressed NS1 polypeptide in the total cell lysates, but not in crude extracts. These results suggest that the expressed NS1 polypeptide is insoluble.

IV.B.14.b. Expression of NS1 in Mammalian Cells

A vector for expression of NS1 in mammalian cells was constructed using a 795 bp fragment obtained by PCR amplification of the NS1 ORF which is contained in plasmid pPGAT/K9-1/59a, described in Section IV.B.14.a. The PCR reaction was performed using the following oligonucleotide sequences as primers.

The primer for the 5'-region of NS1 was:

5' GGA TCC GCT AGC GGC GCC AAG CAG AAC GTC

CAG CTG ATC AAC ACC 3'; (SEQ ID NO:249)

where the underlined sequence encodes an NheI site.

The primer for the 3'-region of NS1 was:

5' GGA TCC AAG CTT TTA CTC GGA CCT GTC CCT

ATC TTC CAG ATC GCA ACG 3'; (SEQ ID NO:250)

where the first and second underlined sequences encode a HindIII site and a stop codon, respectively.

A polyacrylamide gel purified 795 bp fragment was digested with NheI and HindIII. The resulting 777bp NheI-HindIII fragment, which encodes NS1, was ligated to the 3.98 Kbp fragment obtained by digestion of pCMV6a120 with NheI, and partial digestion with HindIII. A resulting plasmid containing the correct insert was designated ptpa-NS1.

The vector pCMV6a120, which is described in U.S. Ser. No. 138,894 filed Dec. 24, 1987 (which is incorporated by reference, along with any foreign filed counterparts), is a mammalian cell expression vector which encodes gp 120 of human immunodeficiency virus (HIV). The pg120 encoding sequence was excised by the digestion with NheI and the partial digestion with HindIII.

Transient expression studies were performed in COS-7 cells (Gluzman (1981)), which had been transfected with ptpa-NS1. Transfection was accomplished using Lipofectin® using techniques described by Felgner et al. (1987). In order to perform immunofluorescence studies, the transfected cells were subcultured into 2-chamber plastic slide wells (Lab-Tek). The COS-7 cells were fixed with acetone at 72 hours following transfection, and cells producing NS1 were identified using indirect immunofluorescence methods (Pachl et al. (1987)). In the immunofluorescence studies, the source of primary antibodies was an HCV positive human antiserum which was immunoreactive with bacterially expressed NS1. The secondary antibody was FITC-conjugated goat anti-human IgG (Tago, Inc., Burlingame, Calif.), which had been diluted 1:200. Immunofluorescence on the slides was observed using a Leitz Dialux 20 EB fluorescent microscope. The cells which were transfected with ptpa-NS1 exhibited a diffuse cytoplasmic immunofluorescent staining pattern. Mock controls were also run. Positive controls included cells transfected with plasmids expressing CMV glycoprotein B, including plasmids pXgB8, the pXgB23clv1-4 series, and the pXgB24clv1-3 series.

IV.B.14.c. Expression of NS1 in Mammalian Cells Using a Vector with a Selectable Marker In order to physically link the NS1 encoding sequence to a sequence encoding a selectable marker, i.e., the DHFR gene, the NS1 ORF DNA sequence was subcloned into two mammalian cell expression vectors, pCMVAdhfr and pMCMVAdhfr. The vector pCMVAdhfr contains the human CMV major immediate early (MIE) promoter, and also contains the mouse dhfr gene linked to the adenovirus major late promoter (Stuve et al. (1987)). The vector pMCMVAdhfr is collinear to pCMVAdhfr, except that murine CMV (MCMV) MIE promoter is substituted for the human CMV MIE promoter. The MCMV MIE promoter is a HpaI-PstI fragment, which was cloned from pON402 (Manning and Mocarski (1988)).

In order to subclone the NS1 ORF DNA, it was excised from ptpa-NS1 by partial digestion with SalI. The 962 bp fragment was then ligated to SalI digested pCMVAdhfr, or to SalI digested pMCMVAdhfr. Each of these vectors contains a unique SalI site.

The recombinant dhfr vectors comprised of the NS1 sequence were used to transfect dhfr⁻ CHO cells in order to generate stable cell lines expressing this ORF. Transfection was by the polybrene transfection procedure of Chaney et al. (1986):

IV.B.15 Epitope Mapping of HCV Genome

IV.B.15.a Synthesis of Overlapping Peptides

Polyethylene pins arranged on a block in an 8'12 array (Coselco Mimetopes, Victoria, Australia) were prepared by placing the pins in a bath (20% v/v piperidine in dimethylformamide (DMF)) for 30 minutes at room temperature. The pins were then removed, washed in DMF for 5 min, then washed in methanol four times (2 min/wash). The pins were allowed to air dry for at least 10 min, then washed a final time in DMF (5 min). 1-Hydroxybenzotriazole (HOBt, 367 mg) was dissolved in DMF (80 mL) for use in coupling Fmoc-protected amino acids: Fmoc-L-Ala-OPfp, Fmoc-L-Cys(Trt)-OPfp, Fmoc-L-Asp(O-tBu)-OPfp, Fmoc-L-Glu(O-tBu)-OPfp, Fmoc-L-Phe-OPfp, Fmoc-Gly-OPfp, Fmoc-L-His(Boc)-OPfp, Fmoc-L-Ile-OPfp, Fmoc-L-Lys(Boc)-OPfp, Fmoc-L-Leu-OPfp, Fmoc-L-Met-OPfp, Fmoc-L-Asn-OPfp, Fmoc-L-Pro-OPfp, Fmoc-L-Gln-OPfp, Fmoc-L-Arg(Mtr)-OPfp, Fmoc-L-Ser(t-Bu)-ODhbt, Fmoc-L-Thr(t-Bu)-ODhbt, Fmoc-L-Val-OPfp, and Fmoc-L-Tyr-OPfp.

The protected amino acids were placed in microtiter plate wells with HOBt, and the pin block placed over the plate, immersing the pins in the wells. The assembly was then sealed in a plastic bag and allowed to react at 25° C. for 18 hours to couple the first amino acids to the pins. The block was then removed, and the pins washed with DMF (2 min), MeOH (4×2 min), and again with DMF (2 min) to clean and deprotect the bound amino acids. The procedure was repeated for each additional amino acid coupled, until all octamers had been prepared.

The free N-termini were then acetylated to compensate for the free amide, as most of the epitopes are not found at the N-terminus and thus would not have the associated positive charge. Acetylation was accomplished by filling the wells of a microtiter plate with DMF/acetic anhydride/triethylamine (5:2:1 v/v/v) and allowing the pins to react in the wells for 90 min at 20° C. The pins were then washed with DMF (2 min) and MeOH (4×2 min), and air dried for at least 10 min.

The side chain protecting groups were removed by treating the pins with trifluoroacetic acid/phenol/dithioethane (95:2.5:2.5, v/v/v) in polypropylene bags for 4 hours at room temperature. The pins were then washed in dichloromethane (2× 2 min), 5% di-isopropylethylamine/dichloromethane (2×5 min), dichloromethane (5 min), and air-dried for at least 10 min. The pins were then washed in water (2 min), MeOH (18 hours), dried in vacuo, and stored in sealed plastic bags over silica gel.

IV.B.15.b Assay of Peptides (A) Procedure:

Octamer-bearing pins prepared according to Section IV.B.15.a were first treated by sonicating for 30 min in a disruption buffer (1% sodium dodecylsulfate, 0.1% 2-mercaptoethanol, 0.1 M $NaH_2PO_4$) at 60° C. The pins were then immersed several times in water (60° C.), followed by boiling MeOH (2 min), and allowed to air dry.

The pins were then precoated for 1 hour at 25° C. in microtiter wells containing 200 mL blocking buffer (1% ovalbumin, 1% BSA, 0.1% Tween®, and 0.05% NaN₃ in PBS), with agitation. The pins were then immersed in microtiter wells containing 175 mL antisera obtained from human patients diagnosed as having HCV and allowed to incubate at 4° C. overnight. The pins were assayed against antisera from three individual patients. Specimen #PAA 3663-s ("A") exhibited strong reaction to HCV Western blots, HCV competitive ELISA, HCV ELISA to clone C100-3 (at 1:1000 dilution), and RIBA responses of >4+ to C100, 5-1-1, and C33c (C22 not done). Neat plasma was diluted 1:500 in blocking buffer. Specimen #PAA 33028 ("B") exhibited strong reaction to HCV Western blots, HCV competitive ELISA, HCV ELISA to clone C100-3 (at 1:500 dilution), and RIBA responses of >4+ to C100, 5-1-1, C33C and C22. Polyclonal antisera was partially purified by passage through a protein A column, and was used at a dilution of 1:200 in blocking buffer. Specimen #PAA s32931 ("C") exhibited moderate reaction to HCV Western blots (3+), HCV competitive ELISA, HCV ELISA to clone C100-3 (at 1:64 dilution), and RIBA responses of 3+ and 4+ to C100 and 5-1-1, respectively (C33c and C22 not done). Polyclonal antisera was partially purified by passage through a protein A column, and was used at a dilution of 1:500 in blocking buffer.

The pins were washed in PBS/Tween® 20 (4×10 min) at room temperature, then incubated in microtiter wells containing horseradish peroxidase-labeled goat anti-Human Ig antisera (175 mL, 1:2000 dilution in blocking buffer without NaN₃) for 1 hour at 25° C. with agitation. The antihuman antisera is specific for human Ig light and heavy chains, and reacts with both IgG and IgM classes. The pins were again washed in PBS/Tween® 20 (4×10 min) at room temperature.

Substrate solution was prepared by diluting NaH₂PO₄ (1 M, 200 mL) and citric acid (1 M, 160 mL) to 2 L with distilled water, adjusting the pH to 4.0. Azino-di-3-ethylbenzthiazodinsulfonate (ABTS, 50 mg) and hydrogen peroxide (0.3 mL/mL) was added to 100 mL of buffer immediately prior to use to complete the substrate solution. The substrate solution (150 mL) was added to each well of a microtiter plate, and the pins immersed in the wells and incubated at 25° C. in the dark. After color developed, the reactions were halted by removing the pins, and absorbance of the solutions read at 405 nm.

(B) Results:

The octamers listed below were immunoreactive with anti-HCV antisera. Peptides reacting with all three antisera are listed as epitopes, while peptides reacting with only one or two antisera are listed as weak epitopes (indicated by "~"). Particularly strong epitopes are labeled with letters rather than numbers (e.g., EpAA).

C22

| 23 | KEPGGGQA | | (SEQ ID NO:251) |
| 24 | EPGGGQAV | | (SEQ ID NO:252) |
| 25 | PGGGQAVG | | (SEQ ID NO:253) |
| 26 | GGGQAVGG | | (SEQ ID NO:254) |
| 27 | GGQAVGGV | | (SEQ ID NO:255) |
| 28 | GQAVGGVY | | (SEQ ID NO:256) |
| 29 | QAVGGVYL~ | | (SEQ ID NO:257) |
| 30 | AVGGVYLL | | (SEQ ID NO:258) |
| 31 | VGGVYLLP | | (SEQ ID NO:259) |
| 32 | GGVYLLPR | | (SEQ ID NO:260) |
| 33 | GVYLLPRR | | (SEQ ID NO:261) |
| 34 | VYLLPRRG | | (SEQ ID NO:262) |
| 35 | YLLPRRGP | | (SEQ ID NO:263) |
| 36 | LLPRRGPR | | (SEQ ID NO:264) |

C22

| 66 | PKARRPEG | Ep1 | (SEQ ID NO:265) |
| 67 | KARRPEGR | | (SEQ ID NO:266) |
| 68 | ARRPEGRT | | (SEQ ID NO:267) |
| 69 | RRPEGRTW | | (SEQ ID NO:268) |
| 70 | RPEGRTWA | | (SEQ ID NO:269) |
| 71 | PEGRTWAQ | | (SEQ ID NO:270) |
| 72 | EGRTWAQP | | (SEQ ID NO:271) |
| 73 | GRTWAQPG | EpA | (SEQ ID NO:272) |
| 74 | RTWAQPGY | | (SEQ ID NO:273) |
| 75 | TWAQPGYP | | (SEQ ID NO:274) |
| 76 | WAQPGYPW | | (SEQ ID NO:275) |
| 77 | AQPGYPWP | | (SEQ ID NO:276) |
| 78 | QPGYPWPL | | (SEQ ID NO:277) |
| 79 | PGYPWPLG | | (SEQ ID NO:278) |
| 80 | GYPWPLYG | | (SEQ ID NO:279) |
| 81 | YPWPLYGN | | (SEQ ID NO:280) |
| 82 | PWPLYGNE | | (SEQ ID NO:281) |
| 83 | WPLYGNEG | | (SEQ ID NO:282) |
| 84 | PLYGNEGC | | (SEQ ID NO:283) |
| 85 | LYGNEGCG | | (SEQ ID NO:284) |
| 86 | YGNEGCGW | | (SEQ ID NO:285) |
| 87 | GNEGCGWA | Ep2 | (SEQ ID NO:286) |
| 88 | NEGCGWAG | | (SEQ ID NO:287) |
| 89 | EGCGWAGW | | (SEQ ID NO:288) |
| 90 | GCGWAGWL | | (SEQ ID NO:289) |
| 91 | CGWAGWLL | | (SEQ ID NO:290) |
| 92 | GWAGWLLS | | (SEQ ID NO:291) |
| 93 | WAGWLLSP | | (SEQ ID NO:292) |
| 94 | AGWLLSPR | | (SEQ ID NO:293) |
| 95 | GWLLSPRG | | (SEQ ID NO:294) |

-continued

| | | | |
|---|---|---|---|
| 96 | WLLSPRGS | | (SEQ ID NO:295) |
| 97 | LLSPRGSR | | (SEQ ID NO:296) |
| 98 | LSPRGSRP | | (SEQ ID NO:297) |
| 99 | SPRGSRPS | | (SEQ ID NO:298) |
| 100 | PRGSRPSW | Ep3 | (SEQ ID NO:299) |
| 101 | RGSRPSWG | | (SEQ ID NO:300) |
| 102 | GSRPSWGP | | (SEQ ID NO:301) |
| 103 | SRPSWGPT | | (SEQ ID NO:302) |
| 186 | TVPASAYQ | Ep4 | (SEQ ID NO:303) |
| 187 | VPASAYQV | | (SEQ ID NO:304) |
| 188 | PASAYQVR | | (SEQ ID NO:305) |
| 189 | ASAYQVRN | | (SEQ ID NO:306) |
| 190 | SAYQVRNS | | (SEQ ID NO:307) |
| 191 | AYQVRNST | | (SEQ ID NO:308) |
| 206 | DCPNSSIV~ | | (SEQ ID NO:309) |
| 223 | TPGCVPCV~ | | (SEQ ID NO:310) |
| 232 | EGNASRCW | Ep5 | (SEQ ID NO:311) |
| 256 | TQLRRHID~ | | (SEQ ID NO:312) |
| 286 | LVGQLFTF~ | | (SEQ ID NO:313) |
| 297 | RHWTTQGC | Ep6 | (SEQ ID NO:314) |
| 298 | HWTTQGCN | | (SEQ ID NO:315) |
| 299 | WTTQGCNC | | (SEQ ID NO:316) |
| 321 | MMMNWSPI~ | | (SEQ ID NO:317) |
| 347 | DMIAGAHW | Ep7 | (SEQ ID NO:318) |
| 357 | LAGIAYFS | Ep8 | (SEQ ID NO:319) |
| 413 | LINTNGSW | EpB | (SEQ ID NO:320) |
| 414 | INTNGSWH | | (SEQ ID NO:321) |
| 432 | SLNTGWLA~ | | (SEQ ID NO:322) |
| 465 | FDQGWGPI | EpC | (SEQ ID NO:323) |
| 466 | DQGWGPIS | | (SEQ ID NO:324) |
| 467 | QGWGPISY | | (SEQ ID NO:325) |
| 468 | GWGPISYA | | (SEQ ID NO:326) |
| 469 | WGPISYAN | | (SEQ ID NO:327) |
| 470 | GPISYANG | | (SEQ ID NO:328) |
| 471 | PJSYANGS | | (SEQ ID NO:329) |
| 480 | PDQRPYCW | EpD | (SEQ ID NO:330) |
| 481 | DQRPYCWH | | (SEQ ID NO:331) |
| 482 | QRPYCWHY | | (SEQ ID NO:332) |
| 483 | RPYCWHYP | | (SEQ ID NO:333) |
| 484 | PYCWHYPP | | (SEQ ID NO:334) |
| 500 | KSVCGPVY | Ep9 | (SEQ ID NO:335) |
| 501 | SVCGPVYC | | (SEQ ID NO:336) |
| 502 | VCGPVYCE | | (SEQ ID NO:337) |
| 521 | RSGAPTYS | Ep10 | (SEQ ID NO:338) |
| 540 | NNTRPPLG | EpE | (SEQ ID NO:339) |
| 541 | NTRPPLGN | | (SEQ ID NO:340) |
| 542 | TRPPLGNW | | (SEQ ID NO:341) |
| 543 | RPPLGNWF | | (SEQ ID NO:342) |
| 544 | PPLGNWFG | | (SEQ ID NO:343) |
| 545 | PLGNWFGC | | (SEQ ID NO:344) |
| 546 | LGNWFGCT | | (SEQ ID NO:345) |
| 547 | GNWFGCTW | | (SEQ ID NO:346) |
| 548 | NWFGCTWM | | (SEQ ID NO:347) |
| 549 | WFGCTWMN | | (SEQ ID NO:348) |
| 579 | LHCPTDCF~ | | (SEQ ID NO:349) |
| 594 | YSRCGSGP | $F_A$ | (SEQ ID NO:350) |
| 595 | SRCGSGPW | | (SEQ ID NO:351) |
| 596 | RCGSGPWL | | (SEQ ID NO:352) |
| 597 | CGSGPWLT | | (SEQ ID NO:353) |
| 598 | GSGPWLTP | | (SEQ ID NO:354) |
| 599 | SGPWLTPR | | (SEQ ID NO:355) |
| 600 | GPWLTPRC | | (SEQ ID NO:356) |
| 601 | PWLTPRCL | | (SEQ ID NO:357) |
| 602 | WLTPRCLV | | (SEQ ID NO:358) |
| 603 | LTPRCLVD | EpF | (SEQ ID NO:359) |
| 604 | TPRCLVDY | | (SEQ ID NO:360) |
| 605 | PRCLVDYP | | (SEQ ID NO:361) |
| 606 | RCLVDYPY | | (SEQ ID NO:362) |
| 607 | CLVDYPYR | | (SEQ ID NO:363) |
| 608 | LVDYPYRL | | (SEQ ID NO:364) |
| 609 | VDYPYRLW | | (SEQ ID NO:365) |
| 610 | DYPYRLWH | | (SEQ ID NO:366) |
| 611 | YPYRLWHY | $F_B$ | (SEQ ID NO:367) |
| 612 | PYRLWHYP | | (SEQ ID NO:368) |
| 613 | YRLWHYPC | | (SEQ ID NO:369) |
| 641 | EAACNWTR | Ep12 | (SEQ ID NO:370) |
| 662 | LSPLLLIJ | Ep13 | (SEQ ID NO:371) |
| 663 | SPLLLIII | | (SEQ ID NO:372) |
| 664 | PLLLIIIQ | | (SEQ ID NO:373) |
| 665 | LLLIIIQW | | (SEQ ID NO:374) |

-continued

| 685 | LSTGLIHL~ | | (SEQ ID NO:375) |
| --- | --- | --- | --- |
| 705 | VGSSIASW~ | | (SEQ ID NO:376) |
| 706 | GSSIASWA | | (SEQ ID NO:377) |
| 729 | ARVCSCIW | Ep14 | (SEQ ID NO:378) |
| 782 | WVPGAVYT | EpG | (SEQ ID NO:379) |
| 783 | VPGAVYTF | | (SEQ ID NO:380) |
| 784 | PGAVYTFY | | (SEQ ID NO:381) |
| 785 | GAVYTFYG | | (SEQ ID NO:382) |
| 786 | AVYTFYGM | | (SEQ ID NO:383) |
| 787 | VYTFYGMW | | (SEQ ID NO:384) |
| 788 | YTFYGMWP | | (SEQ ID NO:385) |
| 789 | TFYGMWPL | | (SEQ ID NO:386) |
| 801 | LALPQRAY~ | | (SEQ ID NO:387) |
| 851 | RVEAQLHV | EpH | (SEQ ID NO:388) |
| 852 | VEAQLHVW | | (SEQ ID NO:389) |
| 853 | EAQLHVWI | | (SEQ ID NO:390) |
| 854 | AQLHVWIP | | (SEQ ID NO:391) |
| 855 | QLHVWIPP | | (SEQ ID NO:392) |
| 893 | LAVFGPLW~ | | (SEQ ID NO:393) |
| 916 | QGLLRFCA~ | | (SEQ ID NO:394) |
| 928 | MIGGHYVQ | Ep15 | (SEQ ID NO:395) |
| 946 | TGTYVYNH | EpI | (SEQ ID NO:396) |
| 952 | NHLTPLRD | EpJ | (SEQ ID NO:397) |
| 953 | HLTPLRDW | | (SEQ ID NO:398) |
| 954 | LTPLRDWA | | (SEQ ID NO:399) |
| 1026 | LAPITAYA~ | | (SEQ ID NO:400) |
| 1072 | TCINGVCW | EpK | (SEQ ID NO:401) |
| 1109 | LVGWPAPQ | Ep16 | (SEQ ID NO:402) |
| 1112 | CPAGHAVG | Ep17 | (SEQ ID NO:403) |
| 1113 | PAGHAVGI | | (SEQ ID NO:404) |
| 1114 | AGHAVGIF | | (SEQ ID NO:405) |
| 1115 | GHAVGIFR | | (SEQ ID NO:406) |
| 1116 | HAVGIFKA | | (SEQ ID NO:407) |
| 1117 | AVGIFKAA | | (SEQ ID NO:408) |
| C33 | | | |
| 1218 | VVPQSEQV | EpL | (SEQ ID NO:409) |
| C33 | | | |
| 1240 | VPAAYAAQ~ | | (SEQ ID NO:410) |
| C33 | | | |
| 1260 | ATLGFGAY~ | | (SEQ ID NO:411) |
| C33 | | | |
| 1280 | GVRITTGS | Ep18 | (SEQ ID NO:412) |
| 1281 | VRITTGSP | | (SEQ ID NO:413) |
| 1282 | RITTGSPI | | (SEQ ID NO:414) |
| 1283 | ITTGSPIT | | (SEQ ID NO:415) |
| 1284 | TTGSPITY | | (SEQ ID NO:416) |
| 1285 | TGSPITYG | | (SEQ ID NO:417) |
| C33 | | | |
| 1322 | DATSILGI~ | | (SEQ ID NO:418) |
| C33 | | | |
| 1338 | TAGARLVV~ | | (SEQ ID NO:419) |
| C33 | | | |
| 1371 | GEIPFYGK | Ep19 | (SEQ ID NO:420) |
| C33 | | | |
| 1384 | VIKGGRHL | Ep20 | (SEQ ID NO:421) |
| C33 | | | |
| 1410 | LGWAVAY | Ep21 | (SEQ ID NO:422) |
| 1411 | GWAVAYY | | (SEQ ID NO:423) |
| C33 | | | |
| 1454 | CNTCVIQT~ | | (SEQ ID NO:424) |
| 1492 | GRGKPGIY | Ep22 | (SEQ ID NO:425) |
| 1493 | RGKPGIYR | | (SEQ ID NO:426) |
| 1532 | PAETTVRL | Ep23 | (SEQ ID NO:427) |
| 1533 | AETTVRLR | | (SEQ ID NO:428) |
| 1534 | ETTVRLRA | | (SEQ ID NO:429) |
| 1535 | TTVRLRAY | | (SEQ ID NO:430) |
| 1560 | GVFIGLIH | Ep24 | (SEQ ID NO:431) |
| 1561 | VFIGLIHI | | (SEQ ID NO:432) |
| C100-3 | | | |
| 1566 | ENLPYLVA | Ep25 | (SEQ ID NO:433) |
| 1567 | NLPYLVAY | | (SEQ ID NO:434) |
| 1568 | LPYLVAYQ | | (SEQ ID NO:435) |
| 1569 | PYLVAYQA | | (SEQ ID NO:436) |
| 1570 | YLVAYQAT | | (SEQ ID NO:437) |
| 1571 | LVAYQATV | | (SEQ ID NO:438) |
| 1572 | VAYQATVC | | (SEQ ID NO:439) |
| 1573 | AYQATVCA | | (SEQ ID NO:440) |
| 1574 | YQATVCAR | | (SEQ ID NO:441) |
| 1575 | QATVCARQ | | (SEQ ID NO:442) |
| 1576 | ATVCARQA | | (SEQ ID NO:443) |

-continued

| | | | |
|---|---|---|---|
| 1577 | TVCARQAP | | (SEQ ID NO:444) |
| C100-3 | | | |
| 1601 | PPSWDQMW | Ep26 | (SEQ ID NO:445) |
| 1602 | PSWDQMWK | | (SEQ ID NO:446) |
| 1603 | SWDQMWKC | | (SEQ ID NO:447) |
| 1604 | WDQMWKCL | | (SEQ ID NO:448) |
| 1605 | DQMWKCLI | | (SEQ ID NO:449) |
| 1606 | QMWKCLIR | | (SEQ ID NO:450) |
| 1607 | MWKCLIRL | | (SEQ ID NO:451) |
| C100-3 | | | |
| 1615 | KPTLHGPI | Ep27 | (SEQ ID NO:452) |
| 1616 | PTLHGPIP | | (SEQ ID NO:453) |
| 1617 | TLHGPIPL | | (SEQ ID NO:454) |
| 1618 | LHGPIPLL | | (SEQ ID NO:455) |
| 1619 | HGPIPLLY | | (SEQ ID NO:456) |
| 1620 | GPIPLLYR | | (SEQ ID NO:457) |
| C100-3 | | | |
| 1655 | VVTSTWVL~ | | (SEQ ID NO:458) |
| 1694 | IIPDREVL | EpM | (SEQ ID NO:459) |
| 1695 | IPDREVLY | | (SEQ ID NO:460) |
| 5-1-1 | | | |
| 1710 | ECSQHLPY | EpN | (SEQ ID NO:461) |
| 1711 | CSQHLPYI | | (SEQ ID NO:462) |
| 1712 | SQHLPYIE | | (SEQ ID NO:463) |
| 5-1-1 | | | |
| 1728 | EKQKALGL | EpO | (SEQ ID NO:464) |
| 1729 | KQKALGLL | | (SEQ ID NO:465) |
| C100-3 | | | |
| 1758 | BIEWAKLM | EpP | (SEQ ID NO:466) |
| 1759 | IEWAKLMW | | (SEQ ID NO:467) |
| 1760 | EWAKLMWN | | (SEQ ID NO:468) |
| 1761 | WAKLMWNE | | (SEQ ID NO:469) |
| 1762 | AKLMWNEI | | (SEQ ID NO:470) |
| C100-3 | | | |
| 1781 | LPGNPAIA~ | | (SEQ ID NO:471) |
| C100-3 | | | |
| 1808 | LFNILGGW | Ep28 | (SEQ ID NO:472) |
| C100-3 | | | |
| 1821 | AAPGAATA~ | | (SEQ ID NO:473) |
| C100-3 | | | |

-continued

| | | | |
|---|---|---|---|
| 1851 | ILAGYGAG | Bp29 | (SEQ ID NO:474) |
| C100-3 | | | |
| 1880 | VNLLPAIL~ | | (SEQ ID NO:475) |
| C100-3 | | | |
| 1908 | PGEGAVQW | EpG | (SEQ ID NO:476) |
| 1909 | GEGAVQWM | | (SEQ ID NO:477) |
| 1910 | EGAVQWMN | | (SEQ ID NO:478) |
| 1911 | GAVQWMNR | | (SEQ ID NO:479) |
| 1912 | AVQWMNRL | | (SEQ ID NO:480) |
| 1913 | VQWMNRLI | | (SEQ ID NO:481) |
| C100-3 | | | |
| 1925 | RGNHVSPI | EpR | (SEQ ID NO:482) |
| C100-3 | | | |
| 1940 | AAARVTAI | Ep30 | (SEQ ID NO:483) |
| 1941 | AARVTAIL | | (SEQ ID NO:484) |
| 1942 | ARVTAILS | | (SEQ ID NO:485) |
| 1943 | RVTAILSS | | (SEQ ID NO:486) |
| 1944 | VTAILSSL | | (SEQ ID NO:487) |
| 1945 | TAILSSLV | | (SEQ ID NO:488) |
| 1946 | AILSSLVT | | (SEQ ID NO:489) |
| 1947 | ILSSLVTQ | | (SEQ ID NO:490) |
| 1948 | LSSLVTQL | | (SEQ ID NO:491) |
| 1949 | SSLVTQLL | | (SEQ ID NO:492) |
| 1950 | SLVTQLLR | | (SEQ ID NO:493) |
| 1951 | LVTQLLRR | | (SEQ ID NO:494) |
| C100-3 | | | |
| 1966 | SBCTIPCS | EpS | (SEQ ID NO:495) |
| 1967 | ECTIPCSG | | (SEQ ID NO:496) |
| 1968 | CTIPCSGS | | (SEQ ID NO:497) |
| 1969 | TIPCSGSW | | (SEQ ID NO:498) |
| C100-3 | | | |
| 1999 | LMPQLPGI | EpT | (SEQ ID NO:499) |
| 2000 | MPQLPGIP | | (SEQ ID NO:500) |
| 2000 | PQLPGIPE | | (SEQ ID NO:501) |
| 2002 | QLPGIPEV | | (SEQ ID NO:502) |
| 2003 | LPGIPEVS | | (SEQ ID NO:503) |
| 2004 | PGIPEVSC | | (SEQ ID NO:504) |
| 2005 | GIPEVSCQ | | (SEQ ID NO:505) |
| 2006 | IPEVSCQR | | (SEQ ID NO:506) |
| 2007 | PEVSCQRG | | (SEQ ID NO:507) |

-continued

| | | | |
|---|---|---|---|
| 2008 | EVSCQRGY | | (SEQ ID NO:508) |
| 2009 | VSCQRGYK | | (SEQ ID NO:509) |
| 2010 | SCQRGYKG | | (SEQ ID NO:510) |
| 2011 | CQRGYKGV | | (SEQ ID NO:511) |
| 2012 | QRGYKGVW | | (SEQ ID NO:512) |
| 2013 | RGYKGVWR | | (SEQ ID NO:513) |
| 2014 | GYKGVWRG | | (SEQ ID NO:514) |
| C100-3 | | | |
| 2024 | IMHTRCHC | Ep31 | (SEQ ID NO:515) |
| C100-3 | | | |
| 2048 | VGPRICRN | EpU | (SEQ ID NO:516) |
| 2049 | GPRICRNY | | (SEQ ID NO:517) |
| 2050 | PRICRNYW | | (SEQ ID NO:518) |
| 2051 | RICRNYWS | | (SEQ ID NO:519) |
| 2052 | ICRNYWSG | | (SEQ ID NO:520) |
| 2053 | CRNYWSGT | | (SEQ ID NO:521) |
| 2054 | RNYWSGTE | | (SEQ ID NO:522) |
| 2055 | NYWSGTEP | | (SEQ ID NO:523) |
| 2056 | YWSGTEPI | | (SEQ ID NO:524) |
| 2057 | WSGTEPIN | | (SEQ ID NO:525) |
| C100-3 | | | |
| 2071 | TPLPAPNY | Bp32 | (SEQ ID NO:526) |
| C100-3 | | | |
| 2088 | EEYVIRQV | EpV | (SEQ ID NO:527) |
| 2089 | EYVIRQVG | | (SEQ ID NO:528) |
| 2090 | YVIRQVGD | | (SEQ ID NO:529) |
| 2091 | VIRQVGDF | | (SEQ ID NO:530) |
| 2092 | JRQVGDFH | | (SEQ ID NO:531) |
| 2093 | RQVGDFHY | | (SEQ ID NO:532) |
| C100-3 | | | |
| 2108 | DNLKCPCQ~ | | (SEQ ID NO:533) |
| C100-3 | | | |
| 2122 | EIELDGVR | EpW | (SEQ ID NO:534) |
| 2123 | IELDGVRL | | (SEQ ID NO:535) |
| 2124 | ELDGVRLH | | (SEQ ID NO:536) |
| 2125 | LDGVRLHR | | (SEQ ID NO:537) |
| 2126 | DGVRLHRF | | (SEQ ID NO:538) |
| 2127 | GVRLHRFA | | (SEQ ID NO:539) |
| 2128 | VRLHRFAP | | (SEQ ID NO:540) |
| 2129 | RLHRFAPP | | (SEQ ID NO:541) |
| 2130 | LHRFAPPC | | (SEQ ID NO:542) |
| 2131 | HRFAPPCK | | (SEQ ID NO:543) |
| 2132 | RFAPPCKP | | (SEQ ID NO:544) |
| 2133 | FAPPCKPL | | (SEQ ID NO:545) |
| 2134 | APPCKPLL | | (SEQ ID NO:546) |
| 2135 | PPCKPLLR | | (SEQ ID NO:547) |
| 2136 | PCKPLLRE | | (SEQ ID NO:548) |
| 2137 | CKPLLREE | | (SEQ ID NO:549) |
| 2138 | KPLLREEV | | (SEQ ID NO:550) |
| 2139 | PLLREEVS | | (SEQ ID NO:551) |
| 2140 | LLREEVSF | EpX | (SEQ ID NO:552) |
| 2141 | LREEVSFR | | (SEQ ID NO:553) |
| 2142 | REEVSFRV | | (SEQ ID NO:554) |
| 2143 | EEVSFRVG | | (SEQ ID NO:555) |
| 2144 | EVSFRVGL | | (SEQ ID NO:556) |
| 2145 | VSFRVGLH | | (SEQ ID NO:557) |
| 2146 | SFRVGLHE | | (SEQ ID NO:558) |
| 2147 | FRVGLHEY | | (SEQ ID NO:559) |
| 2148 | RVGLHEYP | | (SEQ ID NO:560) |
| C100-3 | | | |
| 2165 | EPEPDVAV~ | | (SEQ ID NO:561) |
| C100-3 | | | |
| 2187 | GRRLARGS~ | | (SEQ ID NO:562) |
| C100-3 | | | |
| 2226 | LIEANLLW | BpY | (SEQ ID NO:563) |
| 2227 | IEANLLWR | | (SEQ ID NO:564) |
| 2228 | EANLLWRQ | | (SEQ ID NO:565) |
| 2229 | ANLLWRQE | | (SEQ ID NO:566) |
| 2230 | NLLWRQEM | | (SEQ ID NO:567) |
| 2231 | LLWRQEMG | | (SEQ ID NO:568) |
| 2232 | LWRQEMGG | | (SEQ ID NO:569) |
| C100-3 | | | |
| 2244 | VESENKVV | Ep33 | (SEQ ID NO:570) |
| 2245 | ESENKVVI | | (SEQ ID NO:571) |
| 2246 | SENKVVIL | | (SEQ ID NO:572) |
| 2247 | ENKVVILD | | (SEQ ID NO:573) |
| 2248 | NKVVILDS | | (SEQ ID NO:574) |
| 2249 | KVVILDSF | | (SEQ ID NO:575) |
| 2250 | VVILDSFD | | (SEQ ID NO:576) |
| C100-3 | | | |

-continued

| | | | | |
|---|---|---|---|---|
| 2267 | EISVPAEI | Ep34 | (SEQ ID NO:577) | |
| C100-3 | | | | |
| 2280 | REAQALPV | EpZ | (SEQ ID NO:578) | |
| 2281 | EAQALPVW | | (SEQ ID NO:579) | |
| 2282 | AQALPVWA | | (SEQ ID NO:580) | |
| 2283 | QALPVWAR | | (SEQ ID NO:581) | |
| 2284 | ALPVWARP | | (SEQ ID NO:582) | |
| 2285 | LPVWARPD | | (SEQ ID NO:583) | |
| 2286 | PVWARPDY | | (SEQ ID NO:584) | |
| 2287 | VWARPDYN | | (SEQ ID NO:585) | |
| 2288 | WARPDYNP | | (SEQ ID NO:586) | |
| 2289 | ARPDYNPP | | (SEQ ID NO:587) | |
| 2290 | RPDYNPPL | | (SEQ ID NO:588) | |
| C100-3 | | | | |
| 2325 | PPPRKKRT | Ep35 | (SEQ ID NO:589) | |
| 2326 | PPRKKRTV | | (SEQ ID NO:590) | |
| 2327 | PRKKRTVV | | (SEQ ID NO:591) | |
| C100-3 | | | | |
| 2345 | ABLASRSE | Bp36 | (SEQ ID NO:592) | |
| 2346 | BLASRSBG | | (SEQ ID NO:593) | |
| 2347 | LASRSEGS | | (SEQ ID NO:594) | |
| 2348 | ASRSEGSS | | (SEQ ID NO:595) | |
| 2349 | SRSEGSSS | | (SEQ ID NO:596) | |
| C100-3 | | | | |
| 2382 | AESYSSMP | Ep37 | (SEQ ID NO:597) | |
| C100-3 | | | | |
| 2401 | SDGSWSTV | Ep38 | (SEQ ID NO:598) | |
| C100-3 | | | | |
| 2417 | VVCCSMSY | EpAA | (SEQ ID NO:599) | |
| 2418 | VCCSMSYW | | (SEQ ID NO:600) | |
| 2419 | CCSMSYWI | | (SEQ ID NO:601) | |
| 2420 | CSMSYWIG | | (SEQ ID NO:602) | |
| 2421 | SMSYWIGA | | (SEQ ID NO:603) | |
| 2422 | MSYWIGAL | | (SEQ ID NO:604) | |
| C100-3 | | | | |
| 2439 | QKLPINAL | EpBB | (SEQ ID NO:605) | |
| 2440 | KLPINALS | | (SEQ ID NO:606) | |
| 2441 | LPINALSN | | (SEQ ID NO:607) | |
| 2442 | PINALSNS | | (SEQ ID NO:608) | |
| 2443 | INALSNSL | | (SEQ ID NO:609) | |
| 2444 | NALSNSLL | | (SEQ ID NO:610) | |
| 2445 | ALSNSLLR | | (SEQ ID NO:611) | |
| 2446 | LSNSLLRH | | (SEQ ID NO:612) | |
| 2447 | SNSLLRHH | | (SEQ ID NO:613) | |
| 2448 | NSLLRHHN | | (SEQ ID NO:614) | |
| 2449 | SLLRHHNL | | (SEQ ID NO:615) | |
| 2450 | LLRHHNLV | | (SEQ ID NO:616) | |
| 2451 | LRHHNLVY | | (SEQ ID NO:617) | |
| 2452 | RHHNLVYS | | (SEQ ID NO:618) | |
| 2453 | HHNLVYST | | (SEQ ID NO:619) | |
| 2454 | HNLVYSTI | | (SEQ ID NO:620) | |
| 2455 | NLVYSTIS | | (SEQ ID NO:621) | |
| 2456 | LVYSTISR | | (SEQ ID NO:622) | |
| C100-3 | | | | |
| 2469 | QKKVTFDR | Ep39 | (SEQ ID NO:623) | |
| 2470 | KKVTFDRL | | (SEQ ID NO:624) | |
| 2471 | KVTFDRLQ | | (SEQ ID NO:625) | |
| 2472 | VTFDRLQV | | (SEQ ID NO:626) | |
| 2473 | TFDRLQVL | | (SEQ ID NO:627) | |
| 2474 | FDRLQVLD | | (SEQ ID NO:628) | |
| 2475 | DRLQVLDS | | (SEQ ID NO:629) | |
| 2476 | RLQVLDSH | | (SEQ ID NO:630) | |
| C100-3 | | | | |
| 2495 | ASKVKANL~ | | (SEQ ID NO:631) | |
| C100-3 | | | | |
| 2533 | RKAVTHIN | EpCC | (SEQ ID NO:632) | |
| 2534 | KAVTHINS | | (SEQ ID NO:633) | |
| C100-3 | | | | |
| 2573 | GRKPARLJ | Ep40 | (SEQ ID NO:634) | |
| 2574 | RKPARLIV | | (SEQ ID NO:635) | |
| 2575 | KPARLJVF | | (SEQ ID NO:636) | |
| 2576 | PARLIVFP | | (SEQ ID NO:637) | |
| 2577 | ARLIVFPD | | (SEQ ID NO:638) | |
| 2578 | RLIVFPDL | | (SEQ ID NO:639) | |
| C100-3 | | | | |
| 2602 | LPLAVMGS | EpDD | (SEQ ID NO:640) | |
| 2603 | PLAVMGSS | | (SEQ ID NO:641) | |
| 2604 | LAVMGSSY | | (SEQ ID NO:642) | |
| 2605 | AVMGSSYG | | (SEQ ID NO:643) | |
| 2606 | VMGSSYGE | | (SEQ ID NO:644) | |

| | | | | | | | | |
|---|---|---|---|---|---|---|---|---|
| 2607 | MGSSYGEQ | | (SEQ ID NO:645) | | 2779 | DLELIISC | Ep44 | (SEQ ID NO:677) |
| 2608 | GSSYGEQR | | (SEQ ID NO:646) | | 2780 | LELIISCS | | (SEQ ID NO:678) |
| 2609 | SSYGEQRV | | (SEQ ID NO:647) | | C100-3 | | | |
| 2610 | SYGEQRVE | | (SEQ ID NO:648) | | 2794 | HDGAGKRV | Ep45 | (SEQ ID NO:679) |
| 2611 | YGEQRVEE | | (SEQ ID NO:649) | | 2795 | DGAGKRVY | | (SEQ ID NO:680) |
| 2612 | GEQRVEEL | | (SEQ ID NO:650) | | 2796 | QAGKKVYY | | (SEQ ID NO:681) |
| C100-3 | | | | | 2797 | AGKRVYYL | | (SEQ ID NO:682) |
| 2632 | KTPMGFSY | Ep41 | (SEQ ID NO:651) | | 2798 | GKRVYYLT | | (SEQ ID NO:683) |
| 2633 | TPMGFSYD | | (SEQ ID NO:652) | | 2799 | KRVYYLTR | | (SEQ ID NO:684) |
| 2634 | PMGFSYDT | | (SEQ ID NO:653) | | 2800 | RVYYLTRD | | (SEQ ID NO:685) |
| 2635 | MGFSYDTR | | (SEQ ID NO:654) | | 2801 | VYYLTRDP | | (SEQ ID NO:686) |
| 2636 | GFSYDTRC | | (SEQ ID NO:655) | | 2802 | YYLTRDPT | | (SEQ ID NO:687) |
| 2637 | FSYDTRCE | | (SEQ ID NO:656) | | C100-3 | | | |
| 2638 | SYDTRCED | | (SEQ ID NO:657) | | 2817 | WETARHTP | EpGG | (SEQ ID NO:688) |
| C100-3 | | | | | 2818 | ETARHTPV | | (SEQ ID NO:689) |
| 2660 | YQCCDLDP~ | | (SEQ ID NO:658) | | 2819 | TARHTPVN | | (SEQ ID NO:690) |
| C100-3 | | | | | 2820 | AKHTPVNS | | (SEQ ID NO:691) |
| 2676 | LTERLYVG | EpEE | (SEQ ID NO:659) | | 2821 | RHTPVNSW | | (SEQ ID NO:692) |
| 2677 | TERLYVGG | | (SEQ ID NO:660) | | 2822 | HTPVNSWL | | (SEQ ID NO:693) |
| 2678 | ERLYVGGP | | (SEQ ID NO:661) | | 2823 | TPVNSWLG | | (SEQ ID NO:694) |
| 2679 | RLYVGGPL | | (SEQ ID NO:662) | | 2824 | PVNSWLGN | | (SEQ ID NO:695) |
| C100-3 | | | | | 2825 | VNSWLGNI | | (SEQ ID NO:696) |
| 2688 | NSRGENCG | EpFF | (SEQ ID NO:663) | | 2826 | NSWLGNIJ | | (SEQ ID NO:697) |
| 2689 | SRGENCGY | | (SEQ ID NO:664) | | 2827 | SWLGNIIM | | (SEQ ID NO:698) |
| 2690 | RGENCGYR | | (SEQ ID NO:665) | | 2828 | WLGNIIME | | (SEQ ID NO:699) |
| 2691 | GENCGYRR | | (SEQ ID NO:666) | | 2829 | LGNIIMEA | | (SEQ ID NO:700) |
| 2692 | ENCGYRRC | | (SEQ ID NO:667) | | 2830 | GNIIMEAP | | (SEQ ID NO:701) |
| 2693 | NCGYRRCR | | (SEQ ID NO:668) | | 2831 | NIIMEAPT | | (SEQ ID NO:702) |
| C100-3 | | | | | 2832 | IIMEAPTL | | (SEQ ID NO:703) |
| 2707 | TSCGNTLI | Ep42 | (SEQ ID NO:669) | | 2833 | IMEAPTLW | | (SEQ ID NO:704) |
| C100-3 | | | | | 2834 | MEAPTLWA | | (SEQ ID NO:705) |
| 2721 | AACRAAGL~ | | (SEQ ID NO:670) | | 2835 | EAPTLWAR | | (SEQ ID NO:706) |
| C100-3 | | | | | 2836 | APTLWARM | | (SEQ ID NO:707) |
| 2757 | AFTBAMTR | Ep43 | (SEQ ID NO:671) | | 2837 | PTLWARMI | | (SEQ ID NO:708) |
| 2758 | FTEAMTRY | | (SEQ ID NO:672) | | 2838 | TLWARMIL | | (SEQ ID NO:709) |
| 2759 | TBAMTRYS | | (SEQ ID NO:673) | | 2839 | LWARMILM | | (SEQ ID NO:710) |
| 2760 | EAMTRYSA | | (SEQ ID NO:674) | | 2840 | WARMILMT | | (SEQ ID NO:711) |
| 2761 | AMTRYSAP | | (SEQ ID NO:675) | | 2841 | ARMILMTH | | (SEQ ID NO:712) |
| 2762 | MTRYSAPP | | (SEQ ID NO:676) | | 2842 | RMILMTHF | | (SEQ ID NO:713) |
| C100-3 | | | | | 2843 | MILMTHFE | | (SEQ ID NO:714) |

-continued

C100-3

| 2863 | LDCEIYGA | Ep46 | (SEQ ID NO:715) |
| 2864 | DCEIYGAC | | (SEQ ID NO:716) |
| 2865 | CEIYGACY | | (SEQ ID NO:717) |
| 2866 | EIYGACYS | | (SEQ ID NO:718) |
| 2867 | IYGACYSI | | (SEQ ID NO:719) |

C100-3

| 2878 | DLPPIIQR | Ep47 | (SEQ ID NO:720) |
| 2879 | LPPIIQRL | | (SEQ ID NO:721) |
| 2880 | PPIIQRLH | | (SEQ ID NO:722) |
| 2881 | PIIQRLHG | | (SEQ ID NO:723) |
| 2882 | IIQRLHGL | | (SEQ ID NO:724) |
| 2883 | IQRLHGLS | | (SEQ ID NO:725) |
| 2884 | QRLHGLSA | | (SEQ ID NO:726) |
| 2885 | RLHGLSAF | | (SEQ ID NO:727) |
| 2886 | LHGLSAFS | | (SEQ ID NO:728) |
| 2887 | HGLSAFSL | | (SEQ ID NO:729) |
| 2888 | GLSAFSLH | | (SEQ ID NO:730) |
| 2889 | LSAFSLHS | | (SEQ ID NO:731) |
| 2890 | SAFSLHSY | | (SEQ ID NO:732) |
| 2891 | AFSLHSYS | | (SEQ ID NO:733) |
| 2892 | FSLHSYSP | | (SEQ ID NO:734) |
| 2893 | SLHSYSPG | | (SEQ ID NO:735) |
| 2894 | LHSYSPGE | | (SEQ ID NO:736) |
| 2895 | HSYSPGEI | | (SEQ ID NO:737) |

C100-3

| 2912 | LGVPPLRA | Ep48 | (SEQ ID NO:738) |
| 2913 | GVPPLRAW | | (SEQ ID NO:739) |
| 2914 | VPPLRAWR | | (SEQ ID NO:740) |

C100-3

| 2938 | AAICGKYL | Ep49 | (SEQ ID NO:741) |
| 2939 | AICGKYLE | | (SEQ ID NO:742) |
| 2940 | ICGKYLEN | | (SEQ ID N6:743) |

C100-3

| 2966 | DLSGWETA | EpHH | (SEQ ID NO:744) |

C100-3

| 2984 | VSHARPRW | EpII | (SEQ ID NO:745) |

IV.B.15.c Differential Assay

The following assay was performed to distinguish early antigens from later antigens. Antibodies to the early antigens may be detected, and used to diagnose HCV infection more quickly.

Serial bleeds were obtained from a human patient presenting with elevated ALT, but negative for anti-C100-3 antibody. The five bleeds obtained prior to complete seroconversion (C100-3 positive) were pooled and used in the assay at a dilution of 1:2000. The assay was conducted as described in Section IV.B.15.b above. However, one duplicate set of pins was incubated with horseradish peroxidase-labeled goat anti-Human IgG specific antisera, while the other set was incubated with horseradish peroxidase-labeled goat anti-Human IgM specific antisera. Epitopes immunoreactive with IgM antibodies are early epitopes.

The results indicated that most early epitopes are found in the region extending from about amino acid 480 to about amino acid 650. Particularly strong IgM epitopes were octamers beginning with amino acid nos. 506, 510, 523, 553, 562, 580, and the region from 590 to 620. Assays which employ antigens bearing epitopes from this region will permit diagnosis of HCV infection at an early point than assays employing other antigens.

We have additionally tested serial plasma specimens taken from five patients with open heart post-transfusion NANB hepatitis, with studies followed for 3–12 years. Initial bleed dates were less than one week apart. Each specimen was tested for IgG and IgM by EIA against one core antigen (C22), two envelope antigens (E1 and E2), and three nonstructural region antigens (C33c, C100, and NS5). We found that the IgM response to C22 and C33c preceded the IgG response for those antigens. NS-5 also induced an IgM response, but this response did not precede the IgG response for that antigen. Thus, one can prepare assays capable of determining very early stages of infection by utilizing epitopes derived from the C22 and C33c regions and assaying for IgM binding. Antibodies to the C33c region persisted for the longest period of time, suggesting that diagnostic assays directed toward C33c should be the most reliable.

IV.C. Identification of RNA in Infected Individuals Which Hybridizes to HCV cDNA.

IV.C.1. Identification of RNA in the Liver of a Chimpanzee With NANBH Which Hybridizes to HCV cDNA.

RNA from the liver of a chimpanzee which had NANBH was shown to contain a species of RNA which hybridized to the HCV cDNA contained within clone 81 by Northern blotting, as follows.

RNA was isolated from a liver biopsy of the chimpanzee from which the high titer plasma was derived (see Section IV.A.1.) using techniques described in Maniatis et al. (1982) for the isolation of total RNA from mammalian cells, and for its separation into poly A$^+$ and poly A$^-$ fractions. These RNA fractions were subjected to electrophoresis on a formaldehyde/agarose gel (1% w/v), and transferred to nitrocellulose. (Maniatis et al (1982)). The nitrocellulose filters were hybridized with radiolabeled HCV cDNA from clone 81 (see FIG. 4 for the nucleotide sequence of the insert.) To prepare the radio-labeled probe, the HCV cDNA insert isolated from clone 81 was radiolabeled with $^{32}$P by nick translation using DNA Polymerase I (Maniatis et al (1982)). Hybridization was for 18 hours at 42° C. in a solution containing 10% (w/v) Dextran sulphate, 50% (w/v) deionized formamide, 750 mM NaCl, 75 mM Na citrate, 20 mM Na$_2$HPO$_4$, pH 6.5, 0.1% SDS, 0.02% (w/v) bovine serum albumin (BSA), 0.02% (w/v) Ficoll-400, 0.02% (w/v) polyvinylpyrrolidone, 100 mg/mL salmon sperm DNA which had been sheared by sonication and denatured, and 10$^6$ CPM/mL of the nick-translated cDNA probe.

Figure 38:
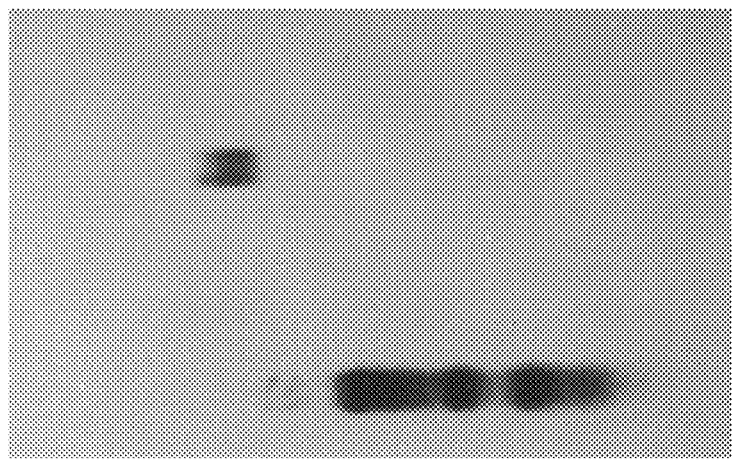
FIG. 38 shows an autoradiograph of a Northern blot of RNA isolated from the liver of a BB-NANBV infected chimpanzee, probed with BB-NANBV cDNA of clone 81.

An autoradiograph of the probed filter is shown in FIG. 38. Lane 1 contains $^{32}$P-labeled restriction fragment markers. Lanes 2–4 contain chimpanzee liver RNA as follows: lane 2 contains 30 mg of total RNA; lane 3 contains 30 mg of poly A– RNA; and lane 4 contains 20 mg of poly A+ RNA. As shown in FIG. 38, the liver of the chimpanzee with NANBH contains a heterogeneous population of related poly A+ RNA molecules which hybridizes to the HCV cDNA probe, and which appears to be from about 5000 nucleotides to about 1,000 nucleotides in size. This RNA, which hybridizes to the HCV cDNA, could represent viral genomes and/or specific transcripts of the viral genome.

The experiment described in Section IV.C.2., infra, is consistent with the suggestion that HCV contains an RNA genome.

IV.C.2. Identification of HCV Derived RNA in Serum from Infected Individuals.

Figure 39:
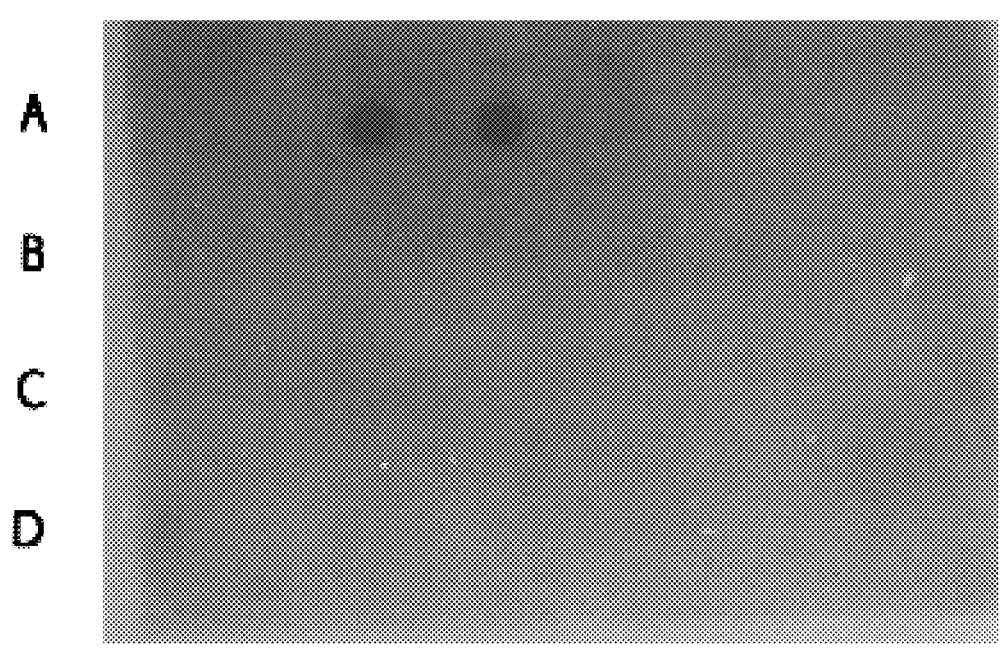
FIG. 39 shows an autoradiograph of NANBV nucleic acid treated with RNase A or DNase I, and probed with BB-NANBV cDNA of clone 81.

Nucleic acids were extracted from particles isolated from high titer chimpanzee NANBH plasma as described in Section IV.A.1. Aliquots (equivalent to 1 mL of original plasma) of the isolated nucleic acids were resuspended in 20 mL 50 mM Hepes, pH 7.5, 1 mm EDTA and 16 mg/mL yeast soluble RNA. The samples were denatured by boiling for 5 minutes followed by immediate freezing, and were treated with RNase A (5 mL containing 0.1 mg/mL RNase A in 25 mM EDTA, 40 mM Hepes, pH 7.5) or with DNase I (5 mL containing 1 unit DNase I in 10 mM $MgCl_2$, 25 mM Hepes, pH 7.5); control samples were incubated without enzyme. Following incubation, 230 mL of ice-cold 2'SSC containing 2 mg/mL yeast soluble RNA was added and the samples were filtered on a nitrocellulose filter. The filters were hybridized with a cDNA probe from clone 81, which had been $^{32}$P-labeled by nick-translation. FIG. 39 shows an autoradiograph of the filter. Hybridization signals were detected in the DNase treated and control samples (lanes 2 and 1, respectively), but were not detected in the RNase treated sample (lane 3). Thus, since RNase A treatment destroyed the nucleic acids isolated from the particles, and DNase I treatment had no effect, the evidence strongly suggests that the HCV genome is composed of RNA.

IV.C.3. Detection of Amplified HCV Nucleic Acid Sequences derived from HCV Nucleic Acid Sequences in Liver and Plasma Specimens from Chimpanzees with NANBH HCV nucleic acids present in liver and plasma of chimpanzees with NANBH, and in control chimpanzees, were amplified using essentially the polymerase chain reaction (PCR) technique described by Saiki et al. (1986). The primer oligonucleotides were derived from the HCV cDNA sequences in clone 81, or clones 36 and 37. The amplified sequences were detected by gel electrophoresis and Southern blotting, using as probes the appropriate cDNA oligomer with a sequence from the region between, but not including, the two primers.

Samples of RNA containing HCV sequences to be examined by the amplification system were isolated from liver biopsies of three chimpanzees with NANBH, and from two control chimpanzees. The isolation of the RNA fraction was by the guanidinium thiocyanate procedure described in Section IV.C.1.

Samples of RNA which were to be examined by the amplification system were also isolated from the plasmas of two chimpanzees with NANBH, and from one control chimpanzee, as well as from a pool of plasmas from control chimpanzees. One infected chimpanzee had a CID/mL equal to or greater than $10^6$, and the other infected chimpanzee had a CID/mL equal to or greater than $10^5$.

The nucleic acids were extracted from the plasma as follows. Either 0.1 mL or 0.01 mL of plasma was diluted to a final volume of 1.0 mL, with a TENB/proteinase K/SDS solution (0.05 M Tris-HCL, pH 8.0, 0.001 M EDTA, 0.1 M NaCl, 1 mg/mL Proteinase K, and 0.5% SDS) containing 10 mg/mL polyadenylic acid, and incubated at 37° C. for 60 minutes. After this proteinase K digestion, the resultant plasma fractions were deproteinized by extraction with TE (10.0 mM Tris-HCl, pH 8.0, 1 mM EDTA) saturated phenol. The phenol phase was separated by centrifugation, and was reextracted with TENB containing 0.1% SDS. The resulting aqueous phases from each extraction were pooled, and extracted twice with an equal volume of phenol/chloroform/isoamyl alcohol [1:1(99:2)], and then twice with an equal volume of a 99:1 mixture of chloroform/isoamyl alcohol. Following phase separation by centrifugation, the aqueous phase was brought to a final concentration of 0.2 M Na acetate, and the nucleic acids were precipitated by the addition of two volumes of ethanol. The precipitated nucleic acids were recovered by ultracentrifugation in a SW 41 rotor at 38 K, for 60 minutes at 4° C.

In addition to the above, the high titer chimpanzee plasma and the pooled control plasma alternatively were extracted with 50 mg of poly-A carrier by the procedure of Chomcyzski and Sacchi (1987). This procedure uses an acid guanidinium thiocyanate extraction. RNA was recovered by centrifugation at 10,000 RPM for 10 minutes at 4° C. in an Eppendorf microfuge.

On two occasions, prior to the synthesis of cDNA in the PCR reaction, the nucleic acids extracted from plasma by the proteinase K/SDS/phenol method were further purified by binding to and elution from S and S Elutip-R Columns. The procedure followed was according to the manufacturer's directions.

The cDNA used as a template for the PCR reaction was derived from the nucleic acids (either total nucleic acids or RNA) prepared as described above. Following ethanol precipitation, the precipitated nucleic acids were dried, and resuspended in DEPC treated distilled water. Secondary structures in the nucleic acids were disrupted by heating at 65° C. for 10 minutes, and the samples were immediately cooled on ice. cDNA was synthesized using 1 to 3 mg of total chimpanzee RNA from liver, or from nucleic acids (or RNA) extracted from 10 to 100 mL of plasma. The synthesis utilized reverse transcriptase, and was in a 25 mL reaction, using the protocol specified by the manufacturer, BRL. The primers for cDNA synthesis were those also utilized in the PCR reaction, described below. All reaction mixtures for cDNA synthesis contained 23 units of the RNAase inhibitor, Rnasin® (Fisher/Promega). Following cDNA synthesis, the reaction mixtures were diluted with water, boiled for 10 minutes, and quickly chilled on ice.

The PCR reactions were performed essentially according to the manufacturer's directions (Cetus/Perkin-Elmer), except for the addition of 1 mg of RNase A. The reactions were carried out in a final volume of 100 mL. The PCR was performed for 35 cycles, utilizing a regimen of 37° C., 72° C., and 94° C.

The primers for cDNA synthesis and for the PCR reactions were derived from the HCV cDNA sequences in either clone 81, clone 36, or clone 37b. (The HCV cDNA sequences of clones 81, 36, and 37b are shown in FIGS. 4, 5, and 10, respectively.) The sequences of the two 16-mer primers derived from clone 81 were:

5' CAA TCA TAC CTG ACA G 3'     (SEQ ID NO:746)

and

5' GAT AAC CTC TGC CTG A 3'     (SEQ ID NO:747).

The sequence of the primer from clone 36 was:

5' GCA TOT CAT CAT GTA T 3'            (SEQ ID NO:748).

The sequence of the primer from clone 37b was:

5' ACA ATA CGT GTG TCA C 3'            (SEQ ID NO:749).

In the PCR reactions, the primer pairs consisted of either the two 16-mers derived from clone 81, or the 16-mer from clone 36 and the 16-mer from clone 37b.

The PCR reaction products were analyzed by separation of the products by alkaline gel electrophoresis, followed by Southern blotting, and detection of the amplified HCV-cDNA sequences with a $^{32}$P-labeled internal oligonucleotide probe derived from a region of the HCV cDNA which does not overlap the primers. The PCR reaction mixtures were extracted with phenol/chloroform, and the nucleic acids precipitated from the aqueous phase with salt and ethanol. The precipitated nucleic acids were collected by centrifugation, and dissolved in distilled water. Aliquots of the samples were subjected to electrophoresis on 1.8% alkaline agarose gels. Single stranded DNA of 60, 108, and 161 nucleotide lengths were co-electrophoresed on the gels as molecular weight markers. After electrophoresis, the DNAs in the gel were transferred onto nucleic acid paper, Biorad Zeta Probe® (Biorad, Hercules, Calif.). Prehybridization and hybridization, and wash conditions were those specified by the manufacturer (Biorad).

The probes used for the hybridization-detection of amplified HCV cDNA sequences were the following. When the pair of PCR primers were derived from clone 81, the probe was an 108-mer with a sequence corresponding to that which is located in the region between the sequences of the two primers. When the pair of PCR primers were derived from clones 36 and 37b, the probe was the nick-translated HCV cDNA insert derived from clone 35. The primers are derived from nucleotides 155–170 of the clone 37b insert, and 206–268 of the clone 36 insert. The 3'-end of the HCV cDNA insert in clone 35 overlaps nucleotides 1–186 of the insert in clone 36; and the 5'-end of clone 35 insert overlaps nucleotides 207–269 of the insert in clone 37b. (Compare FIGS. 5, 8 and 10.) Thus, the cDNA insert in clone 35 spans part of the region between the sequences of the clone 36 and 37b derived primers, and is useful as a probe for the amplified sequences which include these primers.

Analysis of the RNA from the liver specimens was according to the above procedure utilizing both sets of primers and probes. The RNA from the liver of the three chimpanzees with NANBH yielded positive hybridization results for amplification sequences of the expected size (161 and 586 nucleotides for 81 and 36 and 37b, respectively), while the control chimpanzees yielded negative hybridization results. The same results were achieved when the experiment was repeated three times.

Analysis of the nucleic acids and RNA from plasma was also according to the above procedure utilizing the primers and probe from clone 81. The plasmas were from two chimpanzees with NANBH, from a control chimpanzee, and pooled plasmas from control chimpanzees. Both of the NANBH plasmas contained nucleic acids/RNA which yielded positive results in the PCR amplified assay, while both of the control plasmas yielded negative results. These results have been repeatedly obtained several times.

Defective viruses have been known to occur in RNA viruses. By using PCR technology it is possible to design primers to amplify sequences of the HCV genome. By analysis of the amplified products, it is expected to be able to identify both defective versions of the viral genome as well as wild-type viral species. Accordingly, using two primers based on known HCV sequence, one can predict accurately the expected size of the PCR product. Any larger species observed by gel electrophoresis and hybridization analysis could represent potential wild-type genomes. Alternatively, any smaller species observed in this fashion might represent defective agents. Analyses of these types would be useful in confirming the exact origin of the known HCV sequence, whether it is indeed a wild-type viral sequence or a defective genome. Techniques and methods for these analyses are well known in the art and have been previously described. This methodology will enable one skilled in the art to obtain related (wild-type or defective) forms of the viral genome.

IV.D. Radioimmunoassay for Detecting HCV Antibodies in Serum from Infected Individuals Solid phase radioimmunoassays to detect antibodies to HCV antigens were developed based upon Tsu and Herzenberg (1980). Generally, microtiter plates (Immulon 2, Removawell strips) are coated with purified polypeptides containing HCV epitopes. The coated plates are incubated with either human serum samples suspected of containing antibodies to the HCV epitopes, or to appropriate controls. During incubation, antibody, if present, is immunologically bound to the solid phase antigen. After removal of the unbound material and washing of the microtiter plates, complexes of human antibody-NANBV antigen are detected by incubation with $^{125}$I-labeled sheep anti-human immunoglobulin. Unbound labeled antibody is removed by aspiration, and the plates are washed. The radioactivity in individual wells is determined; the amount of bound human anti-HCV antibody is proportional to the radioactivity in the well.

The detection in serum of antibodies to HCV epitopes present in fusion polypeptides of SOD with $NANB_{5-1-1}$, with $NANB_{81}$, with $NANB_{C100}$, and with $NANB_{C33c}$ (these polypeptides are also called SOD-5-1-1, SOD-81, C100-3, and SOD-C33c, respectively), was accomplished by solid phase radioimmunoassay.

Microtiter plates were coated with any of the aforementioned antigens, which had been purified as described herein in Section IV.D.1. (SOD-$NANB_{5-1-1}$), Section IV.D.2. (SOD-$NANB_{81}$), Section IV.B.7. (C100-3), and Section IV.B.9. (SOD-33c). The assays were conducted as follows.

One hundred microliter aliquots containing 0.1 to 0.5 mg of the designated SOD-NANB fusion polypeptide in 0.125 M Na borate buffer, pH 8.3, 0.075 M NaCl (BBS) was added to each well of a microtiter plate (Dynatech Immulon 2 Removawell Strips). The plate was incubated at 4° C. overnight in a humid chamber, after which, the protein solution was removed and the wells washed 3 times with BBS containing 0.02% Triton® X-100 (BBST). To prevent nonspecific binding, the wells were coated with bovine serum albumin (BSA) by addition of 100 mL of a 5 mg/mL solution of BSA in BBS followed by incubation at room temperature for 1 hour; after this incubation the BSA solution was removed. The polypeptides in the coated wells were reacted with serum by adding 100 mL of serum samples diluted 1:100 in 0.01 M Na phosphate buffer, pH 7.2, 0.15 M NaCl (PBS) containing 10 mg/mL BSA, and incubating the serum containing wells for 1 hr at 37° C. After incubation, the serum samples were removed by aspiration, and the wells were washed 5 times with BBST. Anti-$NANB_{5-1-1}$ and Anti-$NANB_{81}$ bound to the fusion polypeptides was determined by the binding of $^{125}$I-labeled F'(ab)$_2$ sheep anti-human IgG to the coated wells. Aliquots of 100 mL of the labeled probe (specific activity 5–20 mCi/mg) were added to each well, and the plates were incubated at 37° C. for 1 hour, followed by removal of excess probe by aspiration, and 5 washes with BBST. The amount of radioactivity bound in each well was determined by counting in a counter which detects gamma radiation.

IV.D.1. Purification of Fusion Polypeptide SOD-NANB$_{5-1-1}$.

The fusion polypeptide SOD-NANB$_{5-1-1}$, expressed in recombinant bacteria as described in Section IV.B.1., was purified from the recombinant E. coli by differential extraction of the cell extracts with urea, followed by chromatography on anion and cation exchange columns as follows.

Thawed cells from 1 liter of culture were resuspended in 10 mL of 20% (w/v) sucrose containing 0.01M Tris HCl, pH 8.0, and 0.4 mL of 0.5M EDTA, pH 8.0 was added. After 5 minutes at 0° C., the mixture was centrifuged at 4,000'g for 10 minutes. The resulting pellet was suspended in 10 mL of 25% (w/v) sucrose containing 0.05 M Tris HCl, pH 8.0, 1 mM phenylmethylsulfonylfluoride (PMSF) and 1 mg/mL pepstatin A, followed by addition of 0.5 mL lysozyme (10 mg/mL) and incubation at 0° C. for 10 minutes. After the addition of 10 mL 1% (v/v) Triton® X-100 in 0.05 M Tris HCl, pH 8.0, 1 mM EDTA, the mixture was incubated an additional 10 min at 0° C. with occasional shaking. The resulting viscous solution was homogenized by passage 6 times through a sterile 20-gauge hypodermic needle, and centrifuged at 13,000×g for 25 minutes. The pelleted material was suspended in 5 mL of 0.01 M Tris HCl pH 8.0, and the suspension centrifuged at 4,000×g for 10 minutes. The pellet, which contained SOD-NANB$_{5-1-1}$ fusion protein, was dissolved in 5 mL of 6 M urea in 0.02 M Tris HCl, pH 8.0, 1 mM dithiothreitol (Buffer A), and was applied to a column of Q-Sepharose® Fast Flow equilibrated with Buffer A. Polypeptides were eluted with a linear gradient of 0.0 to 0.3 M NaCl in Buffer A. After elution, fractions were analyzed by polyacrylamide gel electrophoresis in the presence of SDS to determine their content of SOD-NANB$_{5-1-1}$. Fractions containing this polypeptide were pooled, and dialyzed against 6 M urea in 0.02 M sodium phosphate buffer, pH 6.0, 1 mM dithiothreitol (Buffer B). The dialyzed sample was applied on a column of S-Sepharose® Fast Flow equilibrated with Buffer B, and polypeptides eluted with a linear gradient of 0.0 to 0.3 M NaCl in Buffer B. The fractions were analyzed by polyacrylamide gel electrophoresis for the presence of SOD-NANB$_{5-1-1}$, and the appropriate fractions were pooled.

The final preparation of SOD-NANB$_{5-1-1}$ polypeptide was examined by electrophoresis on polyacrylamide gels in the presence of SDS. Based upon this analysis, the preparation was more than 80% pure.

IV.D.2. Purification of Fusion Polypeptide SOD-NANB$_{81}$.

The fusion polypeptide SOD-NANB$_{81}$, expressed in recombinant bacteria as described in Section IV.B.2., was purified from recombinant *E. coli* by differential extraction of the cell extracts with urea, followed by chromatography on anion and cation exchange columns utilizing the procedure described for the isolation of fusion polypeptide SOD-NANB$_{5-1-1}$ (see Section IV.D.1.).

The final preparation of SOD-NANB$_{81}$ polypeptide was examined by electrophoresis on polyacrylamide gels in the presence of SDS. Based upon this analysis, the preparation was more than 50% pure.

IV.D.3. Detection of Antibodies to HCV Epitopes by Solid Phase Radioimmunoassay.

Serum samples from 32 patients who were diagnosed as having NANBH were analyzed by radioimmunoassay (RIA) to determine whether antibodies to HCV epitopes present in fusion polypeptides SOD-NANB$_{5-1-1}$ and SOD-NANB$_{81}$ were detected.

Microtiter plates were coated with SOD-NANB$_{5-1-1}$ or SOD-NANB$_{81}$, which had been partially purified according to Sections IV.D.1. and IV.D.2., respectively. The assays were conducted as described supra.

The results of the detection of anti-NANB$_{5-1-1}$ and anti-NANB$_{81}$ in individuals with NANBH is presented in Table 1.

TABLE 1

Detection of Anti-5-1-1 and Anti-81 in Sera of NANB, HAV and HBV Hepatitis Patients

| Patient Reference Number | Diagnosis | S/N Anti-5-1-1 | S/N Anti-81 |
|---|---|---|---|
| 1. 28[1] | Chronic NANB, IVD[2] | 0.77 | 4.20 |
| | Chronic NANB, IVD | 1.14 | 5.14 |
| | Chronic NANB, IVD | 2.11 | 4.05 |
| 2. 29[1] | AVH[3], NANB, Sporadic | 1.09 | 1.05 |
| | Chronic, NANB | 33.89 | 11.39 |
| | Chronic, NANB | 36.22 | 13.67 |
| 3. 30[1] | AVH, NANB, IVD | 1.90 | 1.54 |
| | Chronic NANB, IVD | 34.17 | 30.28 |
| | Chronic NANB, IVD | 32.45 | 30.84 |
| 4. 31 | Chronic NANB, PT[4] | 16.09 | 8.05 |
| 5. 32[1] | Late AVH NANB, IVD | 0.69 | 0.94 |
| | Late AVH NANB, IVD | 0.73 | 0.68 |
| 6. 33[1] | AVH, NANB, IVD | 1.66 | 1.96 |
| | AVH, NANB, IVD | 1.53 | 0.56 |
| 7. 34[1] | Chronic NANB, PT | 34.40 | 7.55 |
| | Chronic NANB, PT | 45.55 | 13.11 |
| | Chronic NANB, PT | 41.58 | 13.45 |
| | Chronic NANB, PT | 44.20 | 15.48 |
| 8. 35[1] | AVH NANB, IVD | 31.92 | 31.95 |
| | "Healed" recent NANB, AVH | 6.87 | 4.45 |
| 9. 36 | Late AVH NANB PT | 11.84 | 5.79 |
| 10. 37 | AVH NANB, IVD | 6.52 | 1.33 |
| 11. 38 | Late AVH NANB, PT | 39.44 | 39.18 |
| 12. 39 | Chronic NANB, PT | 42.22 | 37.54 |
| 13. 40 | AVH, NANB, PT | 1.35 | 1.17 |
| 14. 41 | Chronic NANB? PT | 0.35 | 0.28 |
| 15. 42 | AVH, NANB, IVD | 6.25 | 2.34 |
| 16. 43 | Chronic NANB, PT | 0.74 | 0.61 |
| 17. 44 | AVH, NANB, PT | 5.40 | 1.83 |
| 18. 45 | Chronic, NANB, PT | 0.52 | 0.32 |
| 19. 46 | AVH, NANB | 23.25 | 4.45 |
| 20. 47 | AVH, Type A | 1.60 | 1.35 |
| 21. 48 | AVH, Type A | 1.30 | 0.66 |
| 22. 49 | AVH, Type A | 1.44 | 0.74 |
| 23. 50 | Resolved Recent AVH, Type A | 0.48 | 0.56 |
| 24. 51 | AVH, Type A | 0.68 | 0.64 |
| | Resolved AVH, Type A | 0.80 | 0.65 |
| 25. 52 | Resolved Recent AVH, Type A | 1.38 | 1.04 |
| | Resolved Recent AVH, Type A | 0.80 | 0.65 |
| 26. 53 | AVH, Type A | 1.85 | 1.16 |
| | Resolved Recent AVH Type A | 1.02 | 0.88 |
| 27. 54 | AVH, Type A | 1.35 | 0.74 |
| 28. 55 | Late AVH, HBV | 0.58 | 0.55 |
| 29. 56 | Chronic HBV | 0.84 | 1.06 |
| 30. 57 | Late AVH, HBV | 3.20 | 1.60 |
| 31. 58 | Chronic HBV | 0.47 | 0.46 |
| 32. 59[1] | AVH, HBV | 0.73 | 0.60 |
| | Healed AVH, HBV | 0.43 | 0.44 |
| 33. 60[1] | AVH, HBV | 1.06 | 0.92 |
| | Healed AVH, HBV | 0.75 | 0.68 |
| 34. 61[1] | AVH, HBV | 1.66 | 0.61 |
| | Healed AVH, HBV | 0.63 | 0.36 |

TABLE 1-continued Detection of Anti-5-1-1 and Anti-81 in Sera of NANB, HAV and HBV Hepatitis Patients

| Patient Reference Number | Diagnosis | S/N Anti-5-1-1 | Anti-81 |
|---|---|---|---|
| 35. 62[1] | AVH, HBV | 1.02 | 0.73 |
|  | Healed AVH, HBV | 0.41 | 0.42 |
| 36. 63[1] | AVH, HBV | 1.24 | 1.31 |
|  | Healed AVH, HBV | 1.55 | 0.45 |
| 37. 64[1] | AVH, HBV | 0.82 | 0.79 |
|  | Healed AVH, HBV | 0.53 | 0.37 |
| 38. 65[1] | AVH, HBV | 0.95 | 0.92 |
|  | Healed AVH, HBV | 0.70 | 0.50 |
| 39. 66[1] | AVH, HBV | 1.03 | 0.68 |
|  | Healed AVH, HBV | 1.71 | 1.39 |

[1]Sequential serum samples available from these patients
[2]IVD = Intravenous Drug User
[3]AVH = Acute viral hepatitis
[4]PT = Post transfusion As seen in Table 1, 19 of 32 sera from patients diagnosed as having NANBH were positive with respect to antibodies directed against HCV epitopes present in SOD-NANB$_{5-1-1}$ and SOD-NANB$_{81}$.

However, the serum samples which were positive were not equally immunologically reactive with SOD-NANB$_{5-1-1}$ and SOD-NANB$_{81}$. Serum samples from patient No. 1 were positive to SOD-NANB$_{81}$ but not to SOD-NANB$_{5-1-1}$. Serum samples from patients number 10, 15, and 17 were positive to SOD-NANB$_{5-1-1}$ but not to SOD-NANB$_{81}$. Serum samples from patients No. 3, 8, 11, and 12 reacted equally with both fusion polypeptides, whereas serum samples from patients No. 2, 4, 7, and 9 were 2–3 fold higher in the reaction to SOD-NANB$_{5-1-1}$ than to SOD-NANB$_{81}$. These results suggest that NANB$_{5-1-1}$ and NANB$_{81}$ may contain at least 3 different epitopes; i.e., it is possible that each polypeptide contains at least 1 unique epitope, and that the two polypeptides share at least 1 epitope.

IV.D.4. Specificity of the Solid Phase RIA for NANBH

The specificity of the solid phase RIAs for NANBH was tested by using the assay on serum from patients infected with HAV or with HBV and on sera from control individuals. The assays utilizing partially purified SOD-NANB$_{5-1-1}$ and SOD-NANB$_{81}$ were conducted essentially as described in Section IV.D.3, except that the sera was from patients previously diagnosed as having HAV or HBV, or from individuals who were blood bank donors. The results for sera from HAV and HBV infected patients are presented in table 1. The RIA was tested using 11 serum specimens from HAV infected patients, and 20 serum specimens from HBV infected patients. As shown in table 1, none of these sera yielded a positive immunological reaction with the fusion polypeptides containing BB-NANBV epitopes.

The RIA using the NANB$_{5-1-1}$ antigen was used to determine immunological reactivity of serum from control individuals. Out of 230 serum samples obtained from the normal blood donor population, only 2 yielded positive reactions in the RIA (data not shown). It is possible that the two blood donors from whom these serum samples originated had previously been exposed to HCV.

IV.D.5. Reactivity of NANB$_{5-1-1}$ During the Course of NANBH Infection.

The presence of anti-NANB$_{5-1-1}$ antibodies during the course of NANBH infection of 2 patients and 4 chimpanzees was followed using RIA as described in Section IV.D.3. In addition the RIA was used to determine the presence or absence of anti-NANB$_{5-1-1}$ antibodies during the course of infection of HAV and HBV in infected chimpanzees.

The results, which are presented in Table 2, show that with chimpanzees and with humans, anti-NANB$_{5-1-1}$ antibodies were detected following the onset of the acute phase of NANBH infection. Anti-NANB$_{5-1-1}$ antibodies were not detected in serum samples from chimpanzees infected with either HAV or HBV. Thus anti-NANB$_{5-1-1}$ antibodies serve as a marker for an individual's exposure to HCV.

TABLE 2

Seroconversion in Sequential Serum Samples from Hepatitis patients and Chimpanzees Using 5-1-1 Antigen

| Patient/ Chimp | Sample Date (Days) (0 = inoculation day) | Hepatitis Viruses | Anti-5-1-1 (S/N) | ALT (mu/mL) |
|---|---|---|---|---|
| Patient 29 | T[a] | NANB | 1.09 | 1180 |
|  | T + 180 |  | 33.89 | 425 |
|  | T + 208 |  | 36.22 | — |
| Patient 30 | T | NANB | 1.90 | 1830 |
|  | T + 307 |  | 34.17 | 290 |
|  | T + 799 |  | 32.45 | 276 |
| Chimp 1 | 0 | NANB | 0.87 | 9 |
|  | 76 |  | 0.93 | 71 |
|  | 118 |  | 23.67 | 19 |
|  | 154 |  | 32.41 | — |
| Chimp 2 | 0 | NANB | 1.00 | 5 |
|  | 21 |  | 1.08 | 52 |
|  | 73 |  | 4.64 | 13 |
|  | 138 |  | 23.01 | — |
| Chimp 3 | 0 | NANB | 1.08 | 8 |
|  | 43 |  | 1.44 | 205 |
|  | 53 |  | 1.82 | 14 |
|  | 159 |  | 11.87 | 6 |
| Chimp 4 | −3 | NANB | 1.12 | 11 |
|  | 55 |  | 1.25 | 132 |
|  | 83 |  | 6.60 | — |
|  | 140 |  | 17.51 | — |
| Chimp 5 | 0 | HAV | 1.50 | 4 |
|  | 25 |  | 2.39 | 147 |
|  | 40 |  | 1.92 | 18 |
|  | 268 |  | 1.53 | 5 |
| Chimp 6 | −8 | HAV | 0.85 | — |
|  | 15 |  | — | 106 |
|  | 41 |  | 0.81 | 10 |
|  | 129 |  | 1.33 | — |
| Chimp 7 | 0 | HAV | 1.17 | 7 |
|  | 22 |  | 1.60 | 83 |
|  | 115 |  | 1.55 | 5 |
|  | 139 |  | 1.60 | — |
| Chimp 8 | 0 | HAV | 0.77 | 15 |
|  | 26 |  | 1.98 | 130 |
|  | 74 |  | 1.77 | 8 |
|  | 205 |  | 1.27 | 5 |
| Chimp 9 | −290 | HBV | 1.74 | — |
|  | 379 |  | 3.29 | 9 |
|  | 435 |  | 2.77 | 6 |
| Chimp 10 | 0 | HBV | 2.35 | 8 |
|  | 111–118(pool) |  | 2.73 | 96–155 (pool) |
|  | 205 |  | 2.05 | 9 |
|  | 240 |  | 1.78 | 13 |
| Chimp 11 | 0 | HBV | 1.82 | 11 |
|  | 28–56(pool) |  | 1.26 | 8–100 (pool) |
|  | 169 |  | — | 9 |
|  | 223 |  | 0.52 | 10 |

[a]T = day of initial sampling

IV.E. Purification of Polyclonal Serum Antibodies to NANB$_{5-1-1}$

On the basis of the specific immunological reactivity of the SOD-NANB$_{5-1-1}$ polypeptide with the antibodies in serum samples from patients with NANBH, a method was developed to purify serum antibodies which react immunologically with the epitope(s) in NANB$_{5-1-1}$. This method utilizes affinity chromatography. Purified SOD-NANB$_{5-1-1}$ polypeptide (see Section IV.D.1) was attached to an insoluble support; the attachment is such that the immobilized polypeptide retains its affinity for antibody to $NANB_{5-1-1}$. Antibody in serum samples is absorbed to the matrix-bound polypeptide. After washing to remove non-specifically bound materials and unbound materials, the bound antibody is released from the bound SOD-HCV polypeptide by change in pH, and/or by chaotropic reagents, for example, urea.

Nitrocellulose membranes containing bound SOD-$NANB_{5-1-1}$ were prepared as follows. A nitrocellulose membrane, 2.1 cm Sartorius of 0.2 mm pore size, was washed for 3 minutes three times with BBS. SOD-$NANB_{5-1-1}$ was bound to the membrane by incubation of the purified preparation in BBS at room temperature for 2 hours; alternatively it was incubated at 4° C. overnight. The solution containing unbound antigen was removed, and the filter was washed three times with BBS for three minutes per wash. The remaining active sites on the membrane were blocked with BSA by incubation with a 5 mg/mL BSA solution for 30 minutes. Excess BSA was removed by washing the membrane with 5 times with BBS and 3 times with distilled water. The membrane containing the viral antigen and BSA was then treated with 0.05 M glycine hydrochloride, pH 2.5, 0.10 M NaCl (GlyHCl) for 15 minutes, followed by 3 three minute washes with PBS.

Polyclonal anti-$NANB_{5-1-1}$ antibodies were isolated by incubating the membranes containing the fusion polypeptide with serum from an individual with NANBH for 2 hours. After the incubation, the filters were washed 5 times with BBS, and twice with distilled water. Bound antibodies were then eluted from each filter with 5 elutions of GlyHCl, at 3 minutes per elution. The pH of the eluates was adjusted to pH 8.0 by collecting each eluate in a test tube containing 2.0 M Tris HCl, pH 8.0. Recovery of the anti-$NANB_{5-1-1}$ antibody after affinity chromatography is approximately 50%.

The nitrocellulose membranes containing the bound viral antigen can be used several times without appreciable decrease in binding capacity. To reuse the membranes, after the antibodies have been eluted the membranes are washed with BBS three times for 3 minutes. They are then stored in BBS at 4° C.

IV.F. The Capture of HCV Particles from Infected Plasma Using Purified Human Polyclonal Anti-HCV Antibodies; Hybridization of the Nucleic Acid in the Captured Particles to HCV cDNA IV.F.1. The Capture of HCV Particles from Infected Plasma Using Human Polyclonal Anti-HCV Antibodies Protein-nucleic acid complexes present in infectious plasma of a chimpanzee with NANBH were isolated using purified human polyclonal anti-HCV antibodies which were bound to polystyrene beads.

Polyclonal anti-$NANB_{5-1-1}$ antibodies were purified from serum from a human with NANBH using the SOD-HCV polypeptide encoded in clone 5-1-1. The method for purification was that described in Section IV.E.

The purified anti-$NANB_{5-1-1}$ antibodies were bound to polystyrene beads (¼" diameter, specular finish, Precision Plastic Ball Co., Chicago, Ill.) by incubating each at room temperature overnight with 1 mL of antibodies (1 mg/mL in borate buffered saline, pH 8.5). Following the overnight incubation, the beads were washed once with TBST [50 mM Tris HCl, pH 8.0, 150 mM NaCl, 0.05% (v/v) Tween® 20], and then with phosphate buffered saline (PBS) containing 10 mg/mL BSA.

Control beads were prepared in an identical fashion, except that the purified anti-$NANB_{5-1-1}$ antibodies were replaced with total human immunoglobulin.

Capture of HCV from NANBH infected chimpanzee plasma using the anti-$NANB_{5-1-1}$ antibodies bound to beads was accomplished as follows. The plasma from a chimpanzee with NANBH used is described in Section IV.A.1. An aliquot (1 mL) of the NANBV infected chimpanzee plasma was incubated for 3 hours at 37° C. with each of 5 beads coated with either anti-$NANB_{5-1-1}$ antibodies, or with control immunoglobulins. The beads were washed 3 times with TBST.

IV.F.2. Hybridization of the Nucleic Acid in the Captured Particles to NANBV-cDNA The nucleic acid component released from the particles captured with anti-$NANB_{5-1-1}$ antibodies was analyzed for hybridization to HCV cDNA derived from clone 81.

Figure 40:
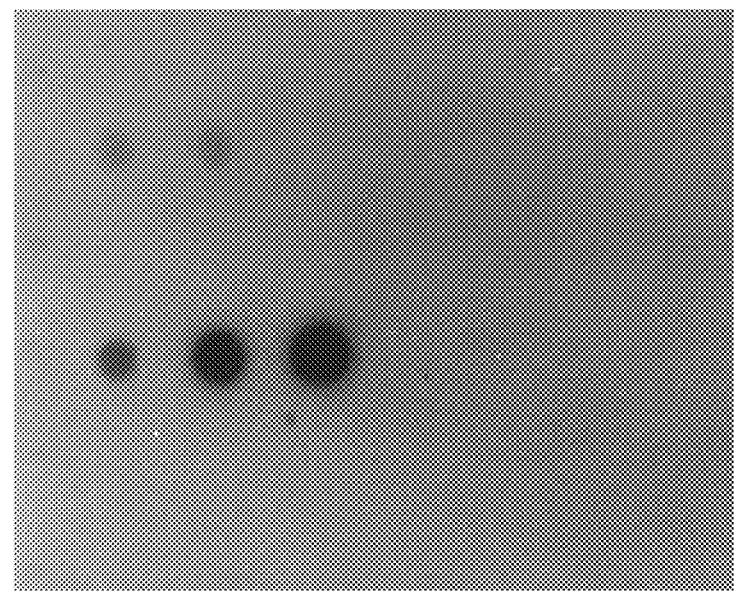
FIG. 40 shows an autoradiograph of nucleic acids extracted from NANBV particles captured from infected plasma with anti-NANB$_{5-1-1}$, and probed with $^{32}$P-labeled NANBV cDNA from clone 81.

HCV particles were captured from NANBH infected chimpanzee plasma, as described in IV.F.1. To release the nucleic acids from the particles, the washed beads were incubated for 60 min. at 37° C. with 0.2 mL per bead of a solution containing proteinase K (1 mg/mL), 10 mM Tris HCl, pH 7.5, 10 mM EDTA, 0.25% (w/v) SDS, 10 mg/mL soluble yeast RNA, and the supernatant solution was removed. The supernatant was extracted with phenol and chloroform, and the nucleic acids precipitated with ethanol overnight at −20° C. The nucleic acid precipitate was collected by centrifugation, dried, and dissolved in 50 mM Hepes, pH 7.5. Duplicate aliquots of the soluble nucleic acids from the samples obtained from beads coated with anti-$NANB_{5-1-1}$ antibodies and with control beads containing total human immunoglobulin were filtered onto to nitrocellulose filters. The filters were hybridized with a $^{32}P$-labeled, nick-translated probe made from the purified HCV cDNA fragment in clone 81. The methods for preparing the probe and for the hybridization are described in Section IV.C.1. Autoradiographs of a probed filter containing the nucleic acids from particles captured by beads containing anti-$NANB_{5-1-1}$ antibodies are shown in FIG. 40. The extract obtained using the anti-$NANB_{5-1-1}$ antibody ($A_1,A_2$) gave clear hybridization signals relative to the control antibody extract ($A_3,A_4$) and to control yeast RNA ($B_1,B_2$). Standards consisting of 1 pg, 5 pg, and 10 pg of the purified, clone 81 cDNA fragment are shown in C1–3, respectively.

These results demonstrate that the particles captured from NANBH plasma by anti-$NANB_{5-1-1}$-antibodies contain nucleic acids which hybridize with HCV cDNA in clone 81, and thus provide further evidence that the cDNAs in these clones are derived from the etiologic agent for NANBH.

IV.G. Immunological Reactivity of C100-3 with Purified Anti-$NANB_{5-1-1}$ Antibodies The immunological reactivity of C100-3 fusion polypeptide with anti-$NANB_{5-1-1}$ antibodies was determined by a radioimmunoassay, in which the antigens which were bound to a solid phase were challenged with purified anti-$NANB_{5-1-1}$ antibodies, and the antigen-antibody complex detected with $^{125}I$-labeled sheep anti-human antibodies. The immunological reactivity of C100-3 polypeptide was compared with that of SOD-$NANB_{5-1-1}$ antigen.

The fusion polypeptide C100-3 was synthesized and purified as described in Section IV.B.5. and in Section IV.B.6., respectively. The fusion polypeptide SOD-$NANB_{5-1-1}$ was synthesized and purified as described in Section IV.B.1. and in Section IV.D.1., respectively. Purified anti-$NANB_{5-1-1}$ antibodies were obtained as described in Section IV.E.

One hundred mL aliquots containing varying amounts of purified C100-3 antigen in 0.125 M Na borate buffer, pH 8.3, 0.075 M NaCl (BBS) was added to each well of a microtiter plate (Dynatech Immulon 2 Removawell Strips). The plate was incubated at 4° C. overnight in a humid chamber, after which, the protein solution was removed and the wells washed 3 times with BBS containing 0.02% Triton® X-100 (BBST). To prevent non-specific binding, the wells were coated with BSA by addition of 100 mL of a 5 mg/mL solution of BSA in BBS followed by incubation at room temperature for 1 hour, after which the excess BSA solution was removed. The polypeptides in the coated wells were reacted with purified anti-NANB$_{5-1-1}$ antibodies by adding 1 mg antibody/well, and incubating the samples for 1 hr at 37° C. After incubation, the excess solution was removed by aspiration, and the wells were washed 5 times with BBST. Anti-NANB$_{5-1-1}$ bound to the fusion polypeptides was determined by the binding of $^{125}$I-labeled F'(ab)$_2$ sheep anti-human IgG to the coated wells. Aliquots of 100 mL of the labeled probe (specific activity 5–20 mCi/mg) were added to each well, and the plates were incubated at 37° C. for 1 hour, followed by removal of excess probe by aspiration, and 5 washes with BBST. The amount of radioactivity bound in each well was determined by counting in a counter which detects gamma radiation.

The results of the immunological reactivity of C100 with purified anti-NANB$_{5-1-1}$ as compared to that of NANB$_{5-1-1}$ with the purified antibodies are shown in Table 3.

TABLE 3

Immunological Reactivity of C100-3 compared to NANB$_{5-1-1}$ by Radioimmunoassay RIA (cpm/assay)

| AG(ng) | 400 | 320 | 240 | 160 | 60 | 0 |
|---|---|---|---|---|---|---|
| NANB$_{5-1-1}$ | 7332 | 6732 | 4954 | 4050 | 3051 | 57 |
| C100-3 | 7450 | 6985 | 5920 | 5593 | 4096 | 67 |

The results in Table 3 show that anti-NANB$_{5-1-1}$ recognizes an epitope(s) in the C100 moiety of the C100-3 polypeptide. Thus NANB$_{5-1-1}$ and C100 share a common epitope(s). The results suggest that the cDNA sequence encoding this NANBV epitope(s) is one which is present in both clone 5-1-1 and in clone 81.

IV.H. Characterization of HCV

IV.H.1. Characterization of the Strandedness of the HCV Genome.

The HCV genome was characterized with respect to its strandedness by isolating the nucleic acid fraction from particles captured on anti-NANB$_{5-1-1}$ antibody coated polystyrene beads, and determining whether the isolated nucleic acid hybridized with plus and/or minus strands of HCV cDNA.

Particles were captured from HCV infected chimpanzee plasma using polystyrene beads coated with immunopurified anti-NANB$_{5-1-1}$ antibody as described in Section IV.F.1. The nucleic acid component of the particles was released using the method described in Section IV.F.2. Aliquots of the isolated genomic nucleic acid equivalent to 3 mLs of high titer plasma were blotted onto nitrocellulose filters. As controls, aliquots of denatured HCV cDNA from clone 81 (2 pg) was also blotted onto the same filters. The filters were probed with $^{32}$P-labeled mixture of plus or mixture of minus strands of single stranded DNA cloned from HCV cDNAs; the cDNAs were excised from clones 40b, 81, and 25c.

The single stranded probes were obtained by excising the HCV cDNAs from clones 81, 40b, and 25c with EcoRI, and cloning the cDNA fragments in M13 vectors, mp18 and mp19 [Messing (1983)]. The M13 clones were sequenced to determine whether they contained the plus or minus strands of DNA derived from the HCV cDNAs. Sequencing was by the dideoxy chain termination method of Sanger et al. (1977).

Figure 41A:
FIG. 41 shows autoradiographs of filters containing isolated NANBV nucleic acids, probed with $^{32}$P-labeled plus and minus strand DNA probes derived from NANBV cDNA in clone 81.
Figure 41B:
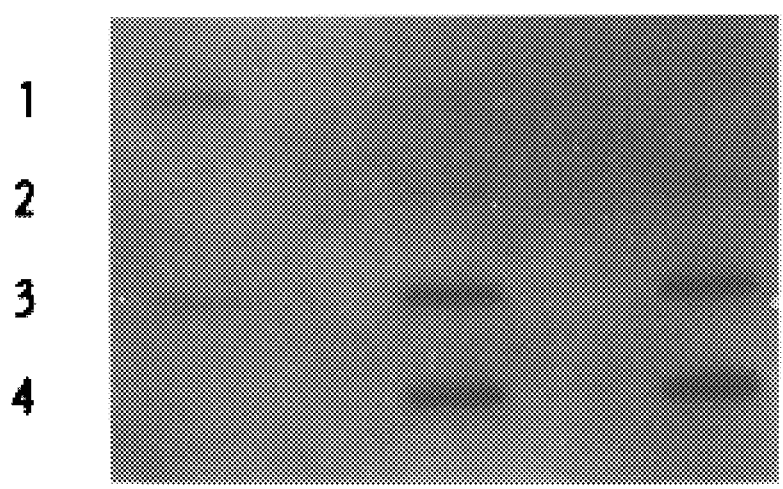

Each of a set of duplicate filters containing aliquots of the HCV genome isolated from the captured particles was hybridized with either plus or minus strand probes derived from the HCV cDNAs. FIG. 41 shows the autoradiographs obtained from probing the NANBV genome with the mixture of probes derived from clones 81, 40b, and 25c. This mixture was used to increase the sensitivity of the hybridization assay. The samples in panel I were hybridized with the plus strand probe mixture. The samples in panel II were probed by hybridization with the minus strand probe mixture. The composition of the samples in the panels of the immunoblot are presented in Table 4.

TABLE 4

| lane | A | B |
|---|---|---|
| 1 | HCV genome | * |
| 2 | — | * |
| 3 | * | cDNA 81 |
| 4 | — | cDNA 81 |

*is an undescribed sample.

As seen from the results in FIG. 41, only the minus strand DNA probe hybridizes with the isolated HCV genome. This result, in combination with the result showing that the genome is sensitive to RNase and not DNase (see Section IV.C.2.), suggests that the genome of NANBV is positive stranded RNA.

These data, and data from other laboratories concerning the physicochemical properties of a putative NANBV(s), are consistent with the possibility that HCV is Flavi-like.

IV.H.2. Detection of Sequences in Captured Particles Which When Amplified by PCR Hybridize to HCV cDNA Derived from Clone 81

The RNA in captured particles was obtained as described in Section IV.H.1. The analysis for sequences which hybridize to the HCV cDNA derived from clone 81 was carried out utilizing the PCR amplification procedure, as described in Section IV.C.3, except that the hybridization probe was a kinased oligonucleotide derived from the clone 81 cDNA sequence. The results showed that the amplified sequences hybridized with the clone 81 derived HCV cDNA probe.

IV.H.3. Homology Between the Non-Structural Protein of Dengue Flavivirus (MNWWVD1) and the HCV Polypeptides Encoded by the Combined ORF of Clones 14i Through 39c The combined HCV cDNAs of clones 14i through 39c contain one continuous ORF, as shown in FIG. 26. The polypeptide encoded therein was analyzed for sequence homology with the region of the non-structural polypeptide(s) in Dengue flavivirus (MNWVD1). The analysis used the Dayhoff protein data base, and was performed on a computer. The results are shown in FIG. 42, where the symbol (:) indicates an exact homology, and the symbol (.) indicates a conservative replacement in the sequence; the dashes indicate spaces inserted into the sequence to achieve the greatest homologies. As seen from the figure, there is significant homology between the sequence encoded in the HCV cDNA, and the non-structural polypeptide(s) of Dengue virus. In addition to the homology shown in FIG. 42, analysis of the polypeptide segment encoded in a region towards the 3'-end of the cDNA also contained sequences which are homologous to sequences in the Dengue polymerase. Of consequence is the finding that the canonical Gly-Asp-Asp (GDD) sequence thought to be essential for RNA-dependent RNA polymerases is contained in the polypeptide encoded in HCV cDNA, in a location which is consistent with that in Dengue 2 virus. (Data not shown.)

IV.H.4. HCV-DNA is Not Detectable in NANBH Infected Tissue

Two types of studies provide results suggesting that HCV-DNA is not detectable in tissue from an individual with NANBH. These results, in conjunction with those described in IV.C. and IV.H.1. and IV.H.2. provide evidence that HCV is not a DNA containing virus, and that its replication does not involve cDNA.

IV.H.4.a. Southern Blotting Procedure

In order to determine whether NANBH infected chimpanzee liver contains detectable HCV-DNA (or HCV-cDNA), restriction enzyme fragments of DNA isolated from this source was Southern blotted, and the blots probed with $^{32}$P-labeled HCV cDNA. The results showed that the labeled HCV cDNA did not hybridize to the blotted DNA from the infected chimpanzee liver. It also did not hybridize to control blotted DNA from normal chimpanzee liver. In contrast, in a positive control, a labeled probe of the b-interferon gene hybridized strongly to Southern blots of restriction enzyme digested human placental DNA. These systems were designed to detect a single copy of the gene which was to be detected with the labeled probe.

DNAs were isolated from the livers of two chimpanzees with NANBH. Control DNAs were isolated from uninfected chimpanzee liver, and from human placentas. The procedure for extracting DNA was essentially according to Maniatis et al. (1982), and the DNA samples were treated with RNase during the isolation procedure.

Each DNA sample was treated with either EcoRI, MboI, or HincII (12 mg), according to the manufacturer's directions. The digested DNAs were electrophoresed on 1% neutral agarose gels, Southern blotted onto nitrocellulose, and the blotted material hybridized with the appropriate nick-translated probe cDNA ($3 \times 10^6$ cpm/mL of hybridization mix). The DNA from infected chimpanzee liver and normal liver were hybridized with $^{32}$P-labeled HCV cDNA from clones 36 plus 81; the DNA from human placenta was hybridized with $^{32}$P-labeled DNA from the β-interferon gene. After hybridization, the blots were washed under stringent conditions, i.e., with a solution containing 0.1× SSC, 0.1% SDS, at 65° C. The β-interferon gene DNA was prepared as described by Houghton et al (1981).

IV.H.4.b. Amplification by the PCR Technique

In order to determine whether HCV-DNA could be detected in liver from chimpanzees with NANBH, DNA was isolated from the tissue, and subjected to the PCR amplification-detection technique using primers and probe polynucleotides derived from HCV cDNA from clone 81. Negative controls were DNA samples isolated from uninfected HepG2 tissue culture cells, and from presumably uninfected human placenta. Positive controls were samples of the negative control DNAs to which a known relatively small amount (250 molecules) of the HCV cDNA insert from clone 81 was added.

In addition, to confirm that RNA fractions isolated from the same livers of chimpanzees with NANBH contained sequences complementary to the HCV-cDNA probe, the PCR amplification-detection system was also used on the isolated RNA samples. In the studies, the DNAs were isolated by the procedure described in Section IV.H.4.a, and RNAs were extracted essentially as described by Chirgwin et al. (1981).

Samples of DNA were isolated from 2 infected chimpanzee livers, from uninfected HepG2 cells, and from human placenta. One mg of each DNA was digested with HindIII according to the manufacturer's directions. The digested samples were subjected to PCR amplification and detection for amplified HCV cDNA essentially as described in Section IV.C.3., except that the reverse transcriptase step was omitted. The PCR primers and probe were from HCV cDNA clone 81, and are described in Section IV.C.3. Prior to the amplification, for positive controls, a 1 mg sample of each DNA was "spiked" by the addition of 250 molecules of HCV cDNA insert isolated from clone 81.

In order to determine whether HCV sequences were present in RNA isolated from the livers of chimpanzees with NANBH, samples containing 0.4 mg of total RNA were subjected to the amplification procedure essentially as described in Section IV.C.3., except that the reverse transcriptase was omitted from some of the samples as a negative control. The PCR primers and probe were from HCV cDNA clone 81, as described supra.

The results showed that amplified sequences complementary to the HCV cDNA probe were not detectable in the DNAs from infected chimpanzee liver, nor were they detectable in the negative controls. In contrast, when the samples, including the DNA from infected chimpanzee liver, was spiked with the HCV cDNA prior to amplification, the clone 81 sequences were detected in all positive control samples. In addition, in the RNA studies, amplified HCV cDNA clone 81 sequences were detected only when reverse transcriptase was used, suggesting strongly that the results were not due to a DNA contamination.

These results show that hepatocytes from chimpanzees with NANBH contain no HCV DNA, or undetectable levels thereof. Based upon the spiking study, if HCV DNA is present, it is at a level far below 0.06 copies per hepatocyte. In contrast, the HCV sequences in total RNA from the same liver samples was readily detected with the PCR technique.

IV.H.5 Comparison of the Hydrophobic Profiles of HCV Polyproteins with West Nile Virus Polyprotein and with Dengue Virus NS1

The hydrophobicity profile of an HCV polyprotein segment was compared with that of a typical flavivirus, West Nile virus. The polypeptide sequence of the West Nile virus polyprotein was deduced from the known polynucleotide sequences encoding the non-structural proteins of that virus. The HCV polyprotein sequence was deduced from the sequence of overlapping cDNA clones. The profiles were determined using an antigen program which uses a window of 7 amino acid width (the amino acid in question, and 3 residues on each side) to report the average hydrophobicity about a given amino acid residue. The parameters giving the reactive hydrophobicity for each amino acid residue are from Kyte and Doolittle (1982). FIG. 55 shows the hydrophobic profiles of the two polyproteins; the areas corresponding to the non-structural proteins of West Nile virus, NS1 through NS5, are indicated in the figure. As seen in the figure, there is a general similarity in the profiles of the HCV polyprotein and the West Nile virus polyprotein.

The sequence of the amino acids encoded in the 5'-region of HCV cDNA shown in FIG. 47 has been compared with the corresponding region of one of the strains of Dengue virus, described supra, with respect to the profile of regions of hydrophobicity and hydrophilicity (data not shown). This comparison indicated that the polypeptides from HCV and Dengue encoded in this region, which corresponds to the region encoding NS1 (or a portion thereof), have a similar hydrophobic/hydrophilic profile.

The similarity in hydrophobicity profiles, in combination with the previously identified homologies in the amino acid sequences of HCV and Dengue Flavivirus in Section IV.H.3., suggests that HCV is related to these members of the Flavivirus family.

IV.H.6. Characterization of the Putative Polypeptides Encoded Within the HCV ORF The sequence of the HCV cDNA sense strand, shown in FIG. 62, was deduced from the overlapping HCV cDNAs in the various clones described in Section IV.A. It may be deduced from the sequence that the HCV genome contains primarily one long continuous ORF, which encodes a polyprotein. The amino acid sequence of the putative HCV polyprotein deduced from the HCV cDNA sense strand sequence is shown in FIG. 66, where position 1 begins with the putative initiator methionine, and the amino acids are indicated by the one-letter code. In the figure, the numbers of the amino acids are at the right of the sequence. The letters above the sequence indicate heterogeneities which have been detected by sequencing a number of clones which overlap the same region; the letters in parentheses indicates that the heterogeneity is possibly due to 5' or 3' terminal cloning artifacts.

IV.H.6.a. The Hydrophilic and Antigenic Profile of the Polypeptide

Profiles of the hydrophilicity/hydrophobicity and the antigenic index of the putative polyprotein encoded in the HCV cDNA sequence shown in FIG. 89 were determined by computer analysis. The program for hydrophilicity/hydrophobicity was as described in Section IV.H.5. The antigenic index results from a computer program which relies on the following criteria: 1)surface probability, 2) prediction of α-helicity by two different methods; 3) prediction of β-sheet regions by two different methods; 4) prediction of U-turns by two different methods; 5) hydrophilicity/hydrophobicity; and flexibility. The traces of the profiles generated by the computer analyses are shown in FIG. 67. In the hydrophilicity profile, deflection above the abscissa indicates hydrophilicity, and below the abscissa indicates hydrophobicity. The probability that a polypeptide region is antigenic is usually considered to increase when there is a deflection upward from the abscissa in the hydrophilic and/or antigenic profile. It should be noted, however, that these profiles are not necessarily indicators of the strength of the immunogenicity of a polypeptide.

IV.H.6.c. Identification of Co-linear Peptides in HCV and Flaviviruses

The amino acid sequence of the putative polyprotein encoded in the HCV cDNA sense strand was compared with the known amino acid sequences of several members of Flaviviruses. The comparison shows that homology is slight, but due to the regions in which it is found, it is probably significant. The conserved colinear regions are shown in FIG. 68. The amino acid numbers listed below the sequences represent the number in the putative HCV polyprotein (see FIG. 66.)

The spacing of these conserved motifs is similar between the Flaviviruses and HCV, and implies that there is some similarity between HCV and these flaviviral agents.

IV.H.7. Sequence Variations in HCV Isolates from Different Individuals

Isolates of HCV which contain sequences which deviate from CDC/HCV1 were identified in human individuals, some of whom were serologically positive for anti-C100-3 antibodies (EC10 was antibody negative). Identification of these new isolates was accomplished by cloning and sequencing segments of the HCV genome which had been amplified by the PCR technique using CDC/HCl sequences. Amplification was accomplished essentially based on an HCV/cPCR method described in U.S. Ser. No. 398,667 filed Aug. 25, 1989, which is commonly owned by the herein assignee, and which is hereby incorporated herein by reference. The method utilizes primers and probes based upon the HCV cDNA sequences described herein. The first step in the method is the synthesis of a cDNA to either the HCV genome, or its replicative intermediate, using reverse transcriptase. After synthesis of the HCV cDNA, and prior to amplification, the RNA in the sample is degraded by techniques known in the art. A designated segment of the HCV cDNA is then amplified by the use of the appropriate primers. The amplified sequences are cloned, and clones containing the amplified sequences are detected by a probe which is complementary to a sequence lying between the primers, but which does not overlap the primers.

IV.H.7.a. HCV Isolates Isolated from Humans in the U.S.

Blood samples which were used as a source of HCV virions were obtained from the American Red Cross in Charlotte, N.C., and from the Community Blood Center of Kansas, Kansas City, Mo. The samples were screened for antibodies to the HCV C100-3 antigen using an ELISA assay as described in Section IV.I.1, and subjected to supplemental Western blot analysis using a polyclonal goat anti-human HRP to measure anti-HCV antibodies. Two samples, #23 and #27, from the American Red Cross and from the Community Blood Center of Kansas, respectively, were determined to be HCV positive by these assays.

Viral particles present in the serum of these samples were isolated by ultracentrifugation under the conditions described by Bradley et al. (1985). RNA was extracted from the particles by digestion with proteinase K and SDS at final concentrations of 10 mg/mL proteinase K, and 0.1% SDS; digestion was for 1 hour at 37° C. Viral RNA was further purified by extraction with chloroform-phenol, as described in Section IV.A.1.

HCV RNA in the preparation of RNA was reverse transcribed into cDNA essentially as described in Section IV.A.1., except that the oligonucleotide JHC 7, which corresponds to the cDNA sequence 1958–1939, and which has the following sequence, was used as primer for the reverse transcriptase reaction.

JHC 7: CCA GCG GTG GCC TGG TAT TG (SEQ ID NO:750).

After both strands of the cDNA were synthesized, the resulting cDNA was then amplified by the PCR method, essentially as described in Section IV.A.34, except that the oligonucleotide primers used, i.e., JHC 6 and ALX 80, were designed to amplify a 1080 nucleotide segment of the HCV genome from CDC/HCV1 nucleotides 673 to 1751. The primers, in addition, are designed to incorporate a NOT I restriction site at the 3'-end of the PCR product, and a blunt end at the 5'-terminus. The sequences of the primers is:

ALX 80: TTT GGG TAA GGT CAT CGA
TAC CCT TAC GTG; (SEQ ID NO:751)

and

JHC 6: ATA TGC GGC CGC CTT CCG
TTG GCA TAA (SEQ ID NO:752).

ALX 80 corresponds to nucleotides 673–702 of the CDC/HCV1 sequence; JHC 6 corresponds to nucleotides 1752–1738 of the HCV1 (in addition there are 12 extra nucleotides which encode a NotI site). The designation of nucleotides in JHC 6, i.e., a declining number, indicates the placement in the anti-sense strand.

After PCR amplification with the above described primers, the blunt end terminus was converted into a NotI site as follows. A homopolymer tail of 15 dGs was attached to the PCR product using terminal deoxynucleotide transferase, and the products were again subjected to amplification by PCR using as primers JHC 6 and JHC 13. The latter primer, JHC 13, the sequence of which follows, is designed to contain a NotI site in addition to an SP6 phage promoter. (The SP6 promoter is described in GENETIC ENGINEERING, J. Setlow Ed. (1988)

JHC 13: AAT TCG CGG CCG CCA TAC GAT TTA GGT GAC

ACT ATA GAA CCC CCC CCC CCC CCC  (SEQ ID NO:753).

In order to clone the amplified HCV cDNA, the PCR products were cleaved with NotI, precipitated with spermine to remove free oligonucleotides (Hoopes et al. (1981)), and cloned into the NotI site of pUC18S (see Section IV.A.34.). The HCV cDNAs in three clones derived from each HCV isolate, were subjected to sequence analysis. Analysis was essentially by the method described in Chen and Seeburg (1985).

Consensus sequences of the clones derived from HCV in samples 23 and 27 are shown in FIG. 80 and FIG. 81, respectively. The variable sequences are also shown in these figures, as are the amino acids encoded in the consensus sequences.

FIGS. 82 and 83 show comparisons of the aligned positive strand nucleotide sequences (FIG. 82) and putative amino acid sequences (FIG. 83) of samples 23, 27, and HCV1. The amino acid sequence of HCV1 in FIG. 83 represents amino acid numbers 129–467 of the HCV polyprotein encoded by the large ORF in the HCV genomic RNA. An examination of FIGS. 82 and 83 show that there are variations in the sequences of the three isolated clones. The sequence variations at the nucleotide level and the amino acid level are summarized in the table immediately below. In the table, the polypeptides designated S and NS1 represent amino acid numbers 130 to ~380, and 380 to ~470, respectively. The numbering is from the putative initiator methionine. The terminology S and NS1 is based upon the positioning of the sequences encoding the polypeptides using the Flavivirus model. As discussed above, however, recent evidence suggests that there is not total correlation between HCV and the Flaviviruses with regard to viral polypeptide domains, particularly in the putative E/NS1 domains. Indeed, HCV polypeptides and their coding domains may exhibit substantial deviation from the Flavivirus model.

TABLE

| | Sequence Homology | | | | | |
|---|---|---|---|---|---|---|
| | Nucleotide Encoding | | | Amino Acid Encoded | | |
| | overall % | S % | NS1 % | overall % | S % | NS1 % |
| HCV1/HCV23 | 93 | 95 | 91 | 92 | 95 | 87 |
| HCV1/HCV27 | 89 | 93 | 84 | 89 | 95 | 82 |
| HCV23/HCV27 | 89 | 93 | 85 | 90 | 93 | 84 |

Although there are variations in the newly isolated HCV sequences, the cloned sequences from samples 23 and 27 (called HCV23 and HCV27) each contain 1019 nucleotides, indicating a lack of deletion and addition mutants in this region in the selected clones. The sequences in FIGS. 82 and 83 also show that the isolated sequences are not rearranged in this region.

A comparison of the consensus sequences for HCV1 and for the other isolates of HCV is summarized in the Table, supra. The sequence variations between the chimpanzee isolate HCV1, and the HCVs isolated from humans are about the same as that seen between the HCVs of human origin.

It is of interest that the sequence variations in two of the putative domains is not uniform. The sequence in a putative S region appears to be relatively constant, and randomly scattered throughout the region. In contrast, a putative NS1 region has a higher degree of variability than the overall sequence, and the variation appears to be in a hypervariable pocket of about 28 amino acids which is located about 70 amino acids downstream from the putative N-terminus of the putative polyprotein.

Although it may be argued that the detected variations were introduced during the amplification process, it is unlikely that all of the variations are from this result. It has been estimated that Taq polymerase introduces errors into a sequence at approximately one base per 10 kilobases of DNA template per cycle (Saiki et al. (1988)). Based upon this estimate, up to 7 errors may have been introduced during the PCR amplification of the 1019 bp DNA fragment. However, the three subclones of HCV-23 and HCV-27 yielded 29 and 14 base variations, respectively. The following suggest that these variations are naturally occurring. About 60% of the base changes are silent mutations which do not change the amino acid sequence. Variations introduced by the Taq polymerase during PCR amplification would be expected to occur randomly; however, the results show that the variant sequences are clustered in at least one specific region.

Moreover, a consensus sequence was derived by sequencing multiple different clones derived from the PCR amplified products.

IV.H.7.b. HCV Isolates from Humans in Italy and in the U.S.

Segments of HCV RNA present in different isolates were amplified by the HCV/cPCR method. These segments span a region of ~0.6 Kb to ~1.6 Kb downstream from the methionine encoding start codon of the putative HCV polyprotein. The isolates are from biological specimens obtained from HCV infected individuals. More specifically, isolate HCT #18 is from human plasma from an individual in the USA, EC1 and EC10 are from a liver biopsy of an Italian patient, and Th is from a peripheral blood mononucleocyte fraction of an American patient. Comparable segments of HCV RNA have been isolated from a chimpanzee.

RNA was extracted from the human plasma specimens using phenol:$CHCl_3$:isoamyl alcohol extraction. Either 0.1 mL or 0.01 mL of plasma was diluted to a final volume of 1.0 mL, with a TENB/proteinase K/SDS solution (0.05 M Tris-HCL, pH 8.0, 0.001 M EDTA, 0.1 M NaCl, 1 mg/mL Proteinase K, and 0.5% SDS) containing 10 to 40 mg/mL polyadenylic acid, and incubated at 37° C. for 60 minutes. After this proteinase K digestion, the resultant plasma fractions were deproteinized by extraction with TE (50 mM Tris-HCl, pH 8.0, 1 mM EDTA) saturated phenol, pH 6.5. The phenol phase was separated by centrifugation, and was reextracted with TENB containing 0.1% SDS. The resulting aqueous phases from each extraction were pooled, and extracted twice with an equal volume of phenol/chloroform/isoamyl alcohol [1:1(99:1)], and then twice with an equal volume of a 99:1 mixture of chloroform/isoamyl alcohol. Following phase separation by centrifugation, the aqueous phase was brought to a final concentration of 0.2 M Na acetate, and the nucleic acids were precipitated by the addition of two volumes of ethanol. The precipitated nucleic acids were recovered by ultracentrifugation in a SW 41 rotor at 38 K, for 60 minutes at 4° C. or in a microfuge for 10 minutes at 10 K, 4° C.

RNA extracted from the liver biopsy was provided by Dr. F. Bonino, Ospedale Maggiore di S. Giovanni Battista, Torino, Italy.

The mononucleocyte fraction was obtained by sedimentation of the individual's aliquot of blood through Ficoll-Paque® (Pharmacia Corp), using the manufacturer's directions. Total RNA was extracted from the fraction using the guanidinium thiocyanate procedure described in Section IV.C.1 (see also Section IV.C.1; See also Choo et al (1989)).

Synthesis of HCV cDNA from the samples was accomplished using reverse transcriptase, and primers derived from clone 156e and from clone K91. These primers, which are anti-sense relative to the genomic RNA, have the following sequences.

156e16B: 5' CGA CAA GAA AGA CAG A 3'  (SEQ ID NO:754), and

K91/16B 5' CGT TGG CAT AAC TGA T 3'  (SEQ ID NO:755).

Following ethanol precipitation, the precipitated RNA or nucleic acid fraction was dried, and resuspended in DEPC treated distilled water. Secondary structures in the nucleic acids were disrupted by heating at 65° C. for 10 minutes, and the samples were immediately cooled on ice. cDNA was synthesized using 1 to 3 mg of total RNA from liver, or from nucleic acids (or RNA) extracted from 10 to 100 mL of plasma. The synthesis utilized reverse transcriptase, and was in a 25 mL reaction, using the protocol specified by the manufacturer, BRL. All reaction mixtures for cDNA synthesis contained 23 units of the RNAase inhibitor, Rnasin® (Fisher/Promega). Following cDNA synthesis, the reaction mixtures were diluted with water, boiled for 10 minutes, and quickly chilled on ice.

Figure 84:
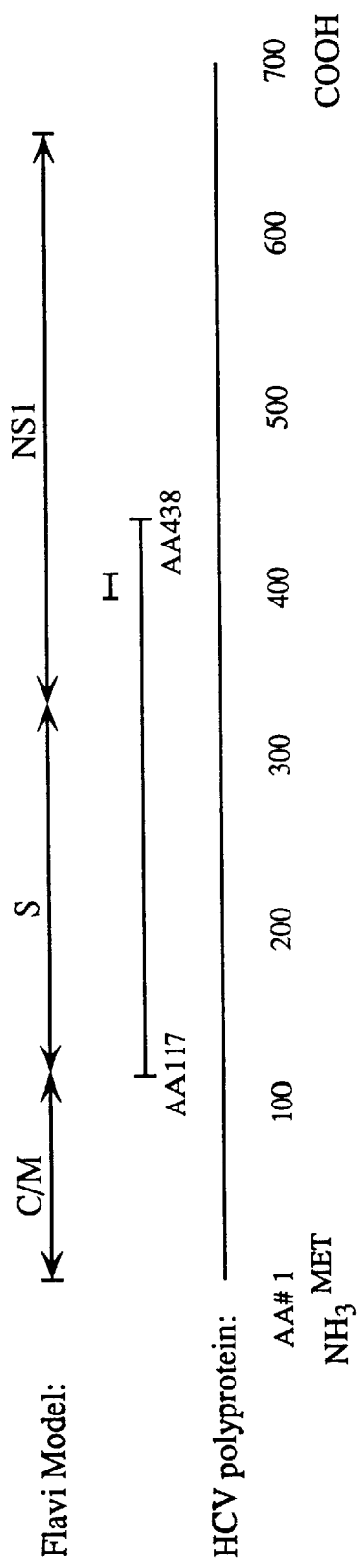
FIG. 84 is a graph showing the relationship of the EnvL and EnvR primers to the model flavivirus polyprotein and putative HCV polyprotein.
Figure 91:
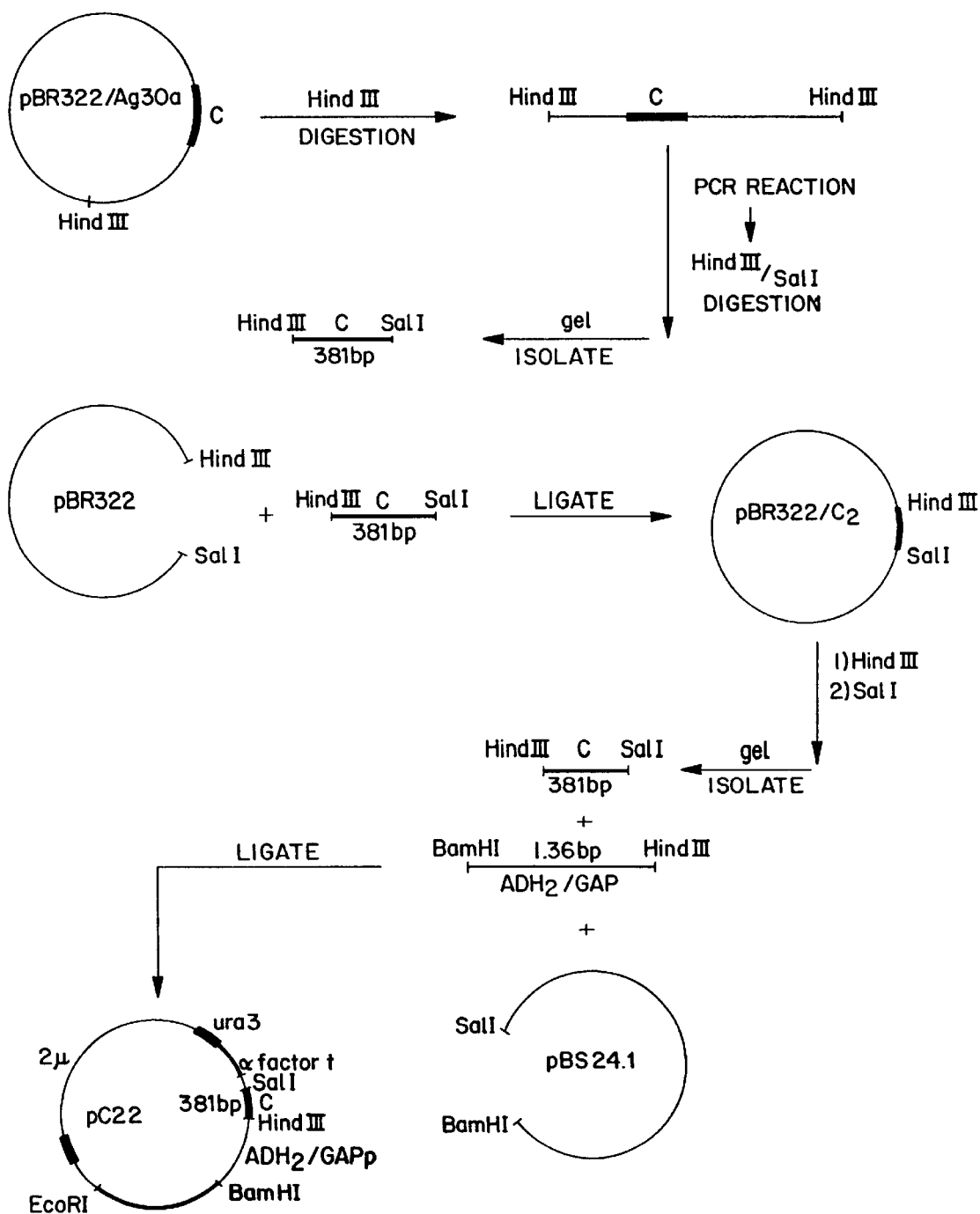
FIG. 91 is a flow chart for the preparation of expression vector pC22.

Each set of samples was subjected to two rounds of PCR amplification. The primers for the reactions were selected to amplify regions designated "EnvL" and EnvR". The "EnvL" region encompasses nucleotides 669–1243, and putative amino acids 117 to 308; the "EnvR" region encompasses nucleotides 1215–1629, and encodes putative amino acids 300–408 (the putative amino acids are numbered starting from the putative methionine initiation codon). The relationship of these regions relative to the putative polyprotein encoded in the HCV cDNA, and to the polypeptides encoded in the Flavivirus model is shown in FIG. 84.

The primers for the first round of PCR reactions were derived from the HCV cDNA sequences in either clone ag30a, clone 156e, or clone k9-1. The primers used for the amplification of the EnvL region were 156e16B (shown supra), and ag30a16A for the sense strand; the amplification of the EnvR region utilized the primer K91/16B (shown supra), and 156e16a for the sense strand. The sequences of the sense strand primers are the following.

For EnvL, ag30a16A: 5' CTC TAT GGC
   AAT GAG G 3',  (SEQ ID NO:756)

and

For EnvR, 156e16A: 5' AGC TTC GAC
   GTC ACA T 3'  (SEQ ID NO:757).

The PCR reactions were performed essentially according to the manufacturer's directions (Cetus-Perkin-Elmer), except for the addition of 1 mg of RNase A. The reactions were carried out in a final volume of 100 mL. The PCR was performed for 30 cycles, utilizing a regimen of 94° C. (I min), 37° C. (2 min), and 72° C. (3 min), with a 7 minute extension at 72° C. for the last cycle. The samples were then extracted with phenol:CHCl$_3$, ethanol precipitated two times, resuspended in 10 mM Tris HCl, pH 8.0, and concentrated using Centricon-30 (Amicon) filtration. This procedure efficiently removes oligonucleotides less than 30 nucleotides in size; thus, the primers from the first round of PCR amplification are removed.

The Centricon-30 concentrated samples were then subjected to a second round of PCR amplification using probes designed from clones 202a and 156e for the EnvL region, and from 156e and 59a for the EnvR region. The primers for amplification of the EnvL region have the following sequences.

202aEnv41a: 5' CTT GAA TTC GCA ATT TGG GTA

AGG TCA TCG ATA CCC TTA CG 3'  (SEQ ID NO:758)

and

156e38B': 5' CTT GAA TTC GAT AGA GCA ATT

GCA ACC TTG CGT CGT CC 3'  (SEQ ID NO:759).

The primers for amplification of the EnvR region in RNAs derived from humans have the following sequences.

156e38A': 5' CTT GAA TTC GGA CGA CGC AAG

GTT GCA ATT GCT CTA TC 3'  (SEQ ID NO:760)

and

59aEnv39C: 5' CTT GAA TTC CAG CCG GTG TTG

AGG CTA TCA TTG CAG TTC 3'  (SEQ ID NO:761).

Amplification by PCR was for 35 cycles utilizing a regimen of 94° C. (1 min), 60° C. (1 min), and 72° C. (2 min), with a 7 minute extension at 72° C. for the last cycle. The samples were then extracted with phenol:CHCl$_3$, precipitated two times, and digested with EcoRI. The PCR reaction products were analyzed by separation of the products by electrophoresis on 6% polyacrylamide gels. DNA of approximately the estimated size of the expected PCR product was electroeluted from the gels, and subcloned into either a pGEM-4 plasmid vector or into λgt11. The expected product sizes for the EnvL and EnvR after the first round of amplification are 615 bp and 683 bp, respectively; after the second round of amplification the expected product sizes for EnvL and EnvR are 414 bp and 575 bp, respectively. The plasmids containing the amplified products were used to transform host cells; the pGEM-4 plasmid was used to transform DH5-alpha, and λgt11 was used to transform C600 delta-HFL. Clones of the transformed cells which either hybridized to the appropriate HCV probes (described below), or those which had inserts of the correct size were selected. The inserts were then cloned in M13 and sequenced.

The probes for all of the HCV/cPCR products consisted of $^{32}$P labeled sections of HCV cDNA which had been prepared by PCR amplification of a region of clone 216 (using CA216a16A and 216a16B as primers), and of clone 84 (using CA84a16A and CA84a16B or CA84a16C as primers); $^{32}$P was introduced into the PCR products by nick translation. The probes for the first and second round of EnvL amplification were from clone 216. Those for the first round of EnvR amplification were from 84 (i.e., CA84a16A and CA84a16B), for the second round of EnvL amplification were CA84a16A and CA84a16C. These probes did not overlap the primers used in the HCV/cPCR reactions. The sequence of the primers for the PCR amplification of the probes is in the following table.

TABLE

| Primer | Clone | Sequence |
|---|---|---|
| CA216a16A | 216 | 5' TGA ACT ATG CAA CAG G 3' (SEQ ID NO:762) |
| CA216a16B | 216 | 5' GGA GTG TGC AGG ATG G 3' (SEQ ID NO:763) |
| CA84a16A | 84 | 5' AAG GTT GCA ATT GCT C 3' (SEQ ID NO:764) |
| CA84a16B | 84 | 5' ACT AAC AGG ACC TTC G 3' (SEQ ID NO:765) |
| CA84a16C | 84 | 5' TAA CGG GTC ACC GCA T 3' (SEQ ID NO:766) |

Figure 85A:
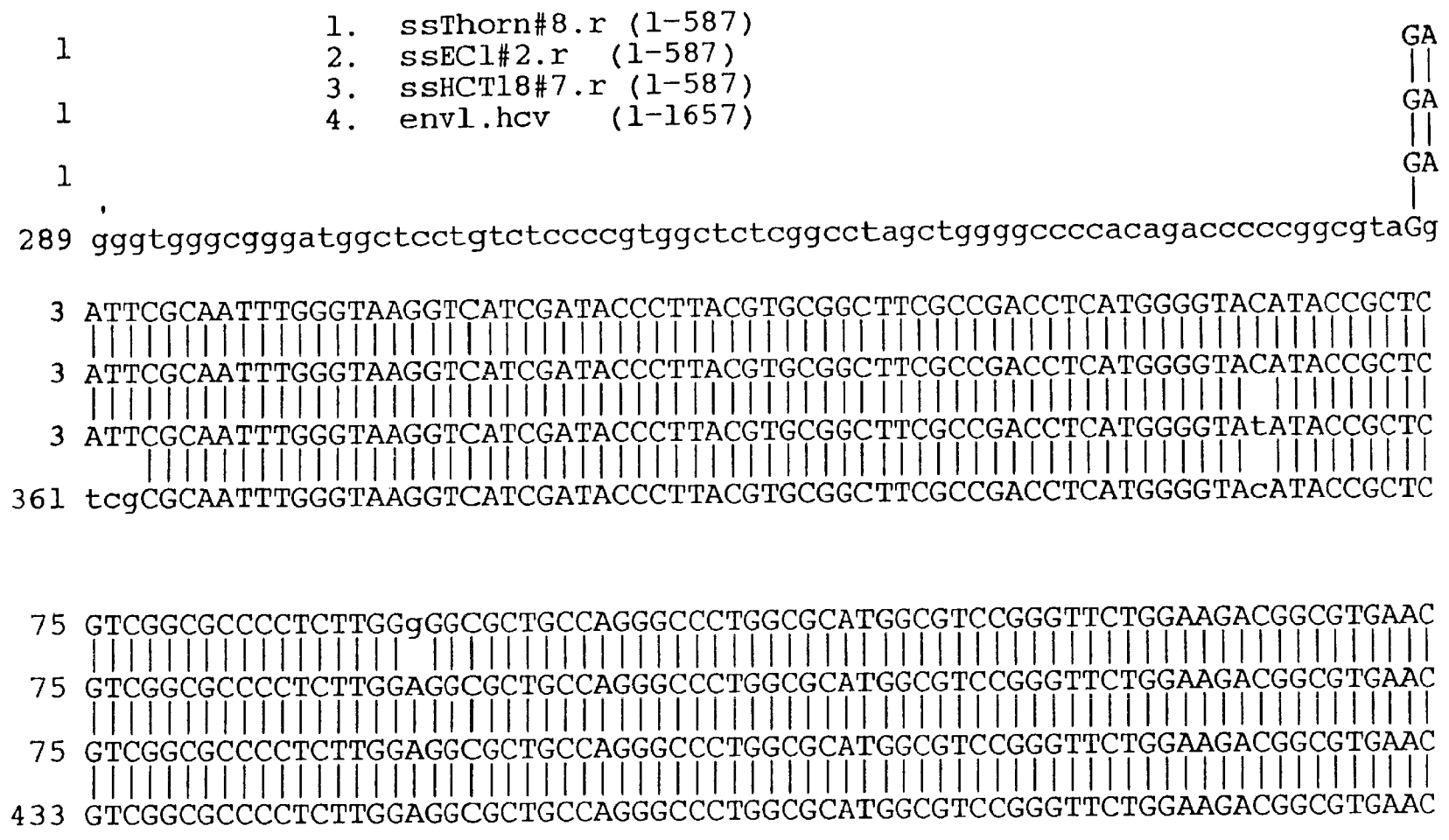
Figure 85C:
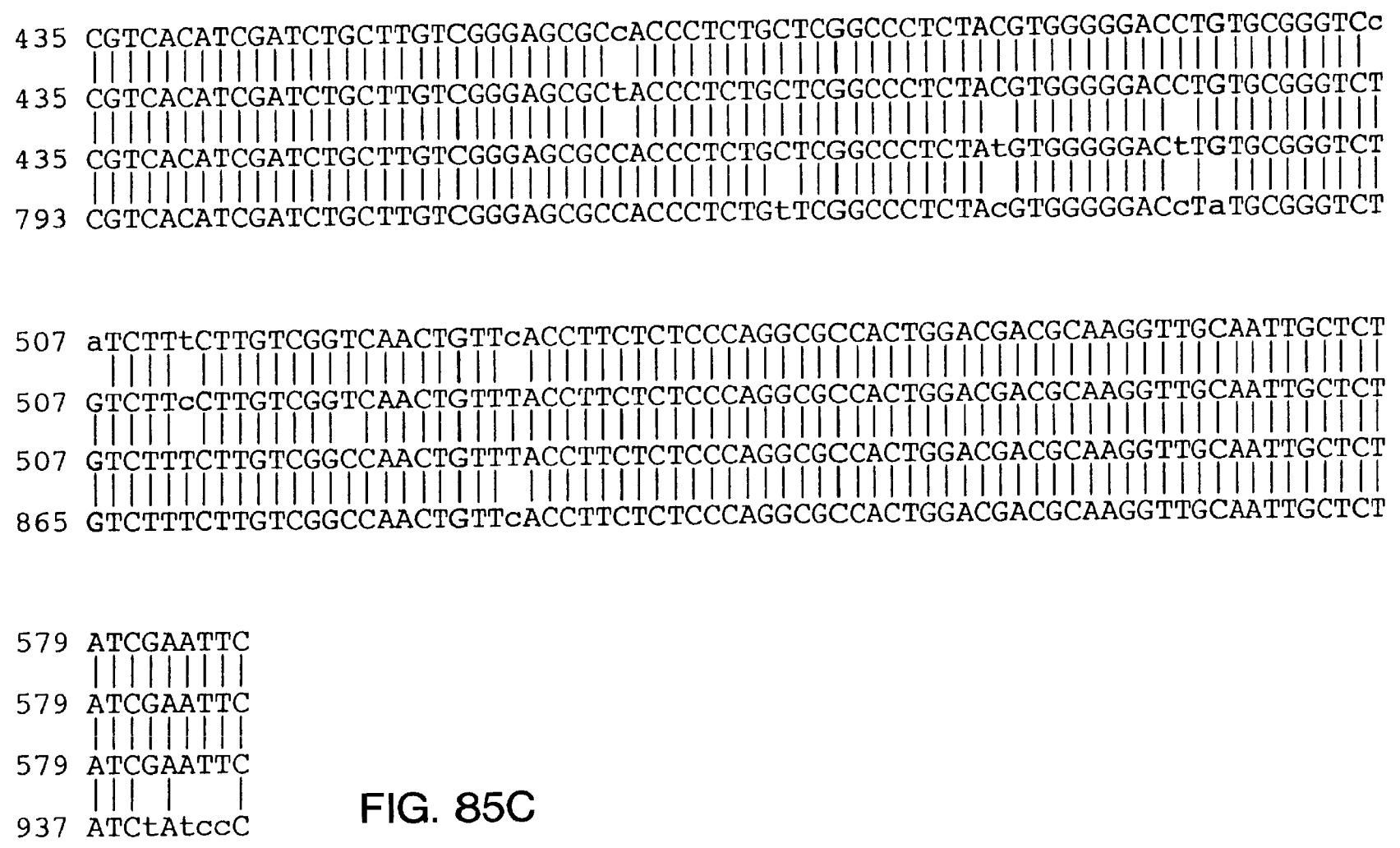

Sequence information on variants in the EnvL region was obtained from 3 clones from HCT #18, 2 clones from TH, 3 clones from EC1, and from the HCV1 clones described in Section IV.A. A comparison of the composite nucleotide sequence of each isolate derived from these clones is shown in FIG. 85. In the figure, each sequence is shown 5' to 3' for the sense strand for the EnvL region, and the sequences have been aligned. The vertical lines and capital letters indicate sequence homology, the absence of a line and an uncapitalized letter indicates a lack of homology. The sequences shown in the lines are as follows: line 1, Thorn; line 2, EC1; line 3, HCT #18; line 4, HCV1.

Sequence information on variants in the EnvR region was obtained from two clones of EC10, and from the HCV1 clones described in Section IV.A. The two EC10 clones differed by only one nucleotide. A comparison of the nucleotide sequences of EC10(clone 2) and a composite of the HCV1 sequences is shown in FIG. 86; each sequence is shown 5' to 3' for the sense strand of the EnvR region, and the sequences have been aligned. The double dots between the sequences indicate sequence homology.

A comparison of the amino acid sequences encoded in the EnvL (amino acids #117–308) and EnvR region (amino acids #300–438) for each of the isolates is shown in FIG. 87 and FIG. 88, respectively. Included in the Figures are sequences for the isolates JH23 and JH27, described in Section IV.H.7.a. Also indicated are sequences from a Japanese isolate; these sequences were provided by Dr. T. Miyamura, Japan. In the figures, the amino acid sequence for the region is given in its entirety for HCV1, and the non-homologous amino acids in the various isolates are indicated.

As seen in FIG. 87, In the EnvL region there is overall about a 93% homology between HCV1 and the other isolates. HCT18, Th, and EC1 have about a 97% homology with HCV1; JH23 and JH27 have about 96% and about 95% homology, respectively, with HCV1. FIG. 88 shows that the homologies in the EnvR region are significantly less than in the EnvL region; moreover, one subregion appears to be hypervariable (i.e., from amino acid 383–405). This data is summarized in the Table immediately below.

TABLE

Homology of EnvR Region

| | Percent Homology with HCV1 | |
|---|---|---|
| Isolate | AA330-AA438 | AA383-AA405 |
| JH23(U.S.) | 83 | 57 |
| JH27(U.S.) | 80 | 39 |
| Japanese | 73 | 48 |
| EC10 (Italy) | 84 | 48 |

IV.H.8. Composite cDNA Sequence of HCV1

As described supra, in Section IV.A., overlapping clones of HCV cDNA from a λgt11 library have been isolated and sequenced. A composite cDNA sequence for HCV1, deduced from overlapping clones b114a, 18g, ag30a, CA205a, CA290a, CA216a, pi14a, CA167b, CA156e, CA84a, CA59a, K9-1 (also called k9-1),26j, 13i, 12f, 14i, 11b, 7f, 7e, 8h, 33c, 40b, 37b, 35, 36, 81, 32, 33b, 25c, 14c, 8f, 33f, 33g, 39c, 35f, 19g, 26g, 15e, b5a, 16jh, 6k, and 131jh is shown in FIG. 89. Shown above the sequence are the position of the putative initiator methionine codon, and nucleotides which vary from the sequence, which produce changes in encoded amino acids. These variant nucleotides were detected by the sequencing of overlapping clones, isolated from the same λgt11 library, described in Section IV.A.1. Clonal heterogeneities which cause many "silent" mutations were detected also, but are not shown in the Figure.

The putative sequence of the major HCV polyprotein encoded in the composite of HCV1 cDNA is shown in FIG. 90. The first amino acid in the sequence is the putative initiator methionine. The variant amino acids, due to the clonal heterogeneities, are indicated above the sequence. Since the λgt11 library was created from serum obtained from one individual (see Section IV.A.1.), the results suggest that variant viral sequences (both nucleotide and amino acid) are present in that individual.

An examination of the composite HCV cDNA sequence in FIG. 89 shows that besides the large ORF, there are a number or ORFs upstream of that encoding the polyprotein, and within the sequence encoding the polyprotein there are a large number of smaller ORFs in the other two translational frames. The ORFs upstream of the HCV polyprotein are shown in the Table immediately below.

TABLE

ORFs Upstream of that Encoding the Large HCV Polyprotein

| Nucl. # | Translation Frame | Amino Acid Sequence |
|---|---|---|
| 10 | 1 | MNHSPVRNYCLHAESV (SEQ ID NO: 767) |
| 63 | 3 | MALV (SEQ ID NO: 768) |
| 74 | 2 | MSVVQPPGPPLPGEP (SEQ ID NO: 769) |
| 193 | 1 | MPGDLGVPPQDC (SEQ ID NO: 770) |

The reading frame, position, and size of the ORFs downstream of the sequence encoding the putative initiator MET of the polyprotein are shown in the Table below. The major polyprotein is that translated from reading frame 2.

TABLE

ORFs Downstream of the Putative Initiator MET Encoding Sequence

| Reading Frame | Size(aa) | Position(bp) |
|---|---|---|
| 1 | 168 | 1015 |
| 1 | 105 | 2662 |
| 1 | 119 | 5935 |
| 2 | 3025 | 278 |
| 3 | 160 | 324 |
| 3 | 111 | 1986 |
| 3 | 148 | 7212 |

In addition to the above, an examination of the sequence which is complementary to the genomic strand of HCV RNA also contains several small ORFs. One of these ORFs encodes a polypeptide of 385 amino acids.

IV.I. ELISA Assays Using HCV Polypeptides

IV.I.1. ELISA Determinations for HCV Infection Using HCV c100-3 As Test Antigen.

All samples were assayed using the HCV c100-3 ELISA. This assay utilizes the HCV c100-3 antigen (which was synthesized and purified as described in Section IV.B.5), and a horseradish peroxidase (HRP) conjugate of mouse monoclonal anti-human IgG.

Plates coated with the HCV c100-3 antigen were prepared as follows. A solution containing Coating buffer (50 mM Na Borate, pH 9.0), 21 mL/plate, BSA (25 mg/mL) c100-3 (2.50 mg/mL) was prepared just prior to addition to the Removeawell Immulon I plates (Dynatech Corp.). After mixing for 5 minutes, 0.2 mL/well of the solution was added to the plates, they were covered and incubated for 2 hours at 37° C., after which the solution was removed by aspiration. The wells were washed with 400 mL Wash Buffer (100 mM sodium phosphate, pH 7.4, 140 mM sodium chloride, 0.1% (W/V) casein, 1% (W/V) Triton X-100, 0.01% (W/V) Thimerosal). After removal of the wash solution, 200 mL/well of Postcoat solution (10 mM sodium phosphate, pH 7.2, 150 mM sodium chloride, 0.1% (w/v) casein, 3% sucrose and 2 mM phenylmethylsulfonylfluoride (PMSF)) was added, the plates were loosely covered to prevent evaporation, and were allowed to stand at room temperature for 30 minutes. The wells were then aspirated to remove the solution, and lyophilized dry overnight, without shelf heating. The prepared plates may be stored at 2–8° C. in sealed aluminum pouches with desiccant (3 g Sorb-it® packs).

In order to perform the ELISA determination, 20 mL of serum sample or control sample was added to a well containing 200 mL of sample diluent (100 mM sodium phosphate, pH 7.4, 500 mM sodium chloride, 1 mM EDTA, 0.1% (w/v) Casein, 0.01% (w/v) Thimerosal, 1% (w/v) Triton® X-100, 100 mg/mL yeast extract). The plates were sealed, and incubated at 37° C. for two hours, after which the solution was removed by aspiration, and the wells were washed three times with 400 mL of wash buffer (phosphate buffered saline (PBS) containing 0.05% Tween® 20). The washed wells were treated with 200 mL of mouse anti-human IgG-HRP conjugate contained in a solution of Ortho conjugate diluent (10 mM sodium phosphate, pH 7.2, 150 mM sodium chloride, 50% (v/v) fetal bovine serum, 1% (v/v) heat treated horse serum, 1 mM $K_3Fe(CN)_6$, 0.05% (w/v) Tween® 20, 0.02% (W/V) Thimerosal). Treatment was for 1 hour at 37° C., the solution was removed by aspiration, and the wells were washed three times with 400 mL wash buffer, which was also removed by aspiration. To determine the amount of bound enzyme conjugate, 200 mL of substrate solution (10 mg O-phenylenediamine dihydrochloride per 5 mL of Developer solution) was added. Developer solution contains 50 mM sodium citrate adjusted to pH 5.1 with phosphoric acid, and 0.6 mg/mL of 30% $H_2O_2$. The plates containing the substrate solution were incubated in the dark for 30 minutes at room temperature, the reactions were stopped by the addition of 50 mg/mL 4N sulfuric acid, and the ODs determined.

The examples provided below show that the microtiter plate screening ELISA which utilizes HCV c100-3 antigen has a high degree of specificity, as evidenced by an initial rate of reactivity of about 1%, with a repeat reactive rate of about 0.5% on random donors. The assay is capable of detecting an immune response in both the post acute phase of the infection, and during the chronic phase of the disease. In addition, the assay is capable of detecting some samples which score negative in the surrogate tests for NANBH; these samples come from individuals with a history of NANBH, or from donors implicated in NANBH transmission.

In the examples described below, the following abbreviations are used:

| ALT | Alanine amino transferase |
|---|---|
| Anti-HBc | Antibody against HBc |
| Anti-HBsAg | Antibody agaiinst HBsAg |
| HBc | Hepatitis B core antigen |
| ABsAg | Hepatitis B surface antigen |
| IgG | Immunoglobulin G |
| IgM | Immunoglobulin M |
| IU/L | International units/Liter |
| NA | Not available |
| NT | Not tested |
| N | Sample size |
| Neg | Negative |
| OD | Optical density |
| Pos | Positive |
| S/CO | Signal/cutoff |
| SD | Standard deviation |
| x | Average or mean |
| WNL | Within normal limits |

IV.I.1.a. HCV Infection in a Population of Random Blood Donors

Figure 43:
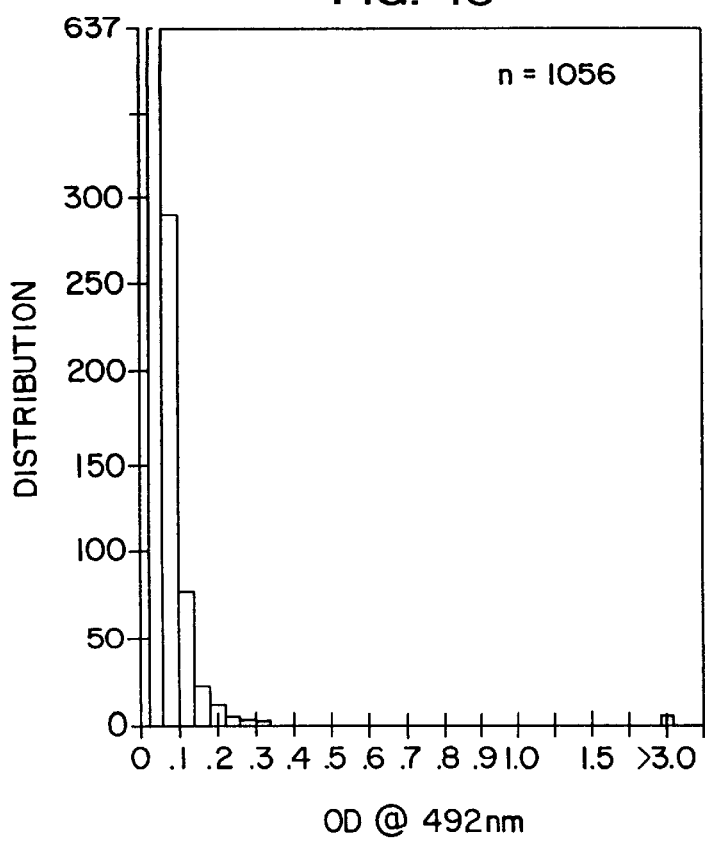
FIG. 43 shows a histogram of the distribution of HCV infection in random samples, as determined by an ELISA screening.

A group of 1,056 samples (fresh sera) from random blood donors were obtained from Irwin Memorial Blood Bank, San Francisco, Calif. The test results obtained with these samples are summarized in a histogram showing the distribution of the OD values (FIG. 43). As seen in FIG. 43, 4 samples read >3, 1 sample reads between 1 and 3, 5 samples read between 0.4 and 1, and the remaining 1,046 samples read <0.4, with over 90% of these samples reading <0.1.

The results on the reactive random samples are presented in Table 5. Using a cut-off value equal to the mean plus 5 standard deviations, ten samples out of the 1,056 (0.95%) were initially reactive. Of these, five samples (0.47%) repeated as reactive when they were assayed a second time using the ELISA. Table 5 also shows the ALT and Anti-HBc status for each of the repeatedly reactive samples. Of particular interest is the fact that all five repeat reactive samples were negative in both surrogate tests for NANBH, while scoring positive in the HCV ELISA.

TABLE 5

Results on Reactive Random Samples
N = 1051, x = 0.049*, SD = ±0.074
Cut-off: x + 5 SD = 0.419(0.400 + Negative Control)

| Samples | Initial Reactives OD | Repeat Reactives OD | ALT** | Anti HBc*** |
|---|---|---|---|---|
| 4227 | 0.462 | 0.084 | NA | (OD) |
| 6292 | 0.569 | 0.294 | NA | NA |
| 6188 | 0.699 | 0.326 | NA | NA |
| 6157 | 0.735 | 0.187 | NA | NA |
| 6277 | 0.883 | 0.152 | NA | NA |
| 6397 | 1.567 | 1.392 | 30.14 | 1.433 |
| 6019 | >3.000 | >3.000 | 46.48 | 1.057 |
| 6651 | >3.000 | >3.000 | 48.53 | 1.343 |
| 6669 | >3.000 | >3.000 | 60.53 | 1.165 |
| 4003 | >3.000 | >3.000 | WNL**** | Neg. |
| | 10/1056 = 0.9.5% | | 5/1056 = 0.47% | |

*Samples reading >1.5 were not included in calculating the Mean and SD
**ALT ≧ 68 IU/L is above normal limits.
***Anti-HBc ≦ 0.535 (competition assay) is considered positive.
****WNL: Within normal limits IV.I.1.b Chimpanzee Serum Samples Serum samples from eleven chimpanzees were tested with the HCV c100-3 ELISA. Four of these chimpanzees were infected with NANBH from a contaminated batch of Factor VIII (presumably Hutchinson strain), following an established procedure in a collaboration with Dr. Daniel Bradley at the Centers for Disease Control. As controls, four other chimpanzees were infected with HAV and three with HBV. Serum samples were obtained at different times after infection.

The results, which are summarized in Table 6, show documented antibody seroconversion in all chimpanzees infected with the Hutchinson strain of NANBH. Following the acute phase of infection (as evidenced by the significant rise and subsequent return to normal of ALT levels), antibodies to HCV c100-3 became detectable in the sera of the 4/4 NANBH infected chimpanzees. These samples had previously been shown, as discussed in Section IV.B.3., to be positive by a Western analysis, and an RIA. In contrast, none of the control chimpanzees which had been infected with HAV or HBV showed evidence of reactivity in the ELISA.

TABLE 6

Chimpanzee Serum Samples

| | OD | S/CO | Inoculation Date | Bleed Date | ALT (IU/L) | Transfused |
|---|---|---|---|---|---|---|
| Neg. Control | 0.001 | | | | | |
| Pos. Control | 1.504 | | | | | |
| Cutoff | 0.401 | | | | | |
| Chimp 1 | −0.007 | 0.00 | 5/24/84 | 5/24/84 | 9 | NANB |
| | 0.003 | 0.01 | | 8/07/84 | 71 | |
| | >3.000 | >7.48 | | 09/18/84 | 19 | |
| | >3.000 | >7.48 | | 10/24/84 | — | |
| Chimp 2 | — | — | 6/07/84 | — | — | NANB |
| | −0.003 | 0.00 | | 5/31/84 | 5 | |
| | −0.005 | 0.00 | | 6/28/84 | 52 | |
| | 0.945 | 2.36 | | 9/20/84 | 13 | |
| | >3.000 | >7.48 | | 10/24/84 | — | |
| Chimp 3 | 0.005 | 0.01 | 3/14/85 | 3/14/85 | 8 | NANB |
| | 0.017 | 0.04 | | 4/26/85 | 205 | |
| | 0.006 | 0.01 | | 5/06/85 | 14 | |
| | 1.010 | 2.52 | | 8/20/85 | 6 | |
| Chimp 4 | −0.006 | 0.00 | 3/11/85 | 3/11/85 | 4 | HAV |
| | 0.001 | 0.00 | | 5/09/85 | 132 | |
| | 0.523 | 1.31 | | 6/06/85 | — | |
| | 1.574 | 3.93 | | 8/01/85 | — | |
| Chimp 5 | −0.006 | 0.00 | 11/21/80 | 11/21/80 | 4 | HAV |
| | 0.001 | 0.00 | | 12/16/80 | 147 | |
| | 0.003 | 0.01 | | 12/30/80 | 18 | |
| | 0.006 | 0.01 | | 7/29–8/21/81 | 5 | |
| Chimp 6 | — | — | 5/25/82 | 5/17/82 | — | HAV |
| | −0.005 | 0.00 | | 6/10/82 | 106 | |
| | 0.001 | 0.00 | | 7/06/82 | 10 | |
| | −0.004 | 0.00 | | 10/01/82 | — | |
| | 0.290 | 0.72 | | | | |
| Chimp 7 | −0.008 | 0.00 | 5/25/82 | 5/25/82 | 7 | HAV |
| | −0.004 | 0.00 | | 6/17/82 | 83 | |
| | −0.006 | 0.00 | | 9/16/82 | 5 | |
| | 0.005 | 0.01 | | 10/09/82 | — | |
| Chimp 8 | −0.007 | 0.00 | 11/21/80 | 11/21/80 | 15 | HAV |
| | 0.000 | 0.00 | | 12/16/80 | 130 | |
| | 0.004 | 0.01 | | 2/03/81 | 8 | |
| | 0.000 | 0.00 | | 6/03–6/10/81 | 4.5 | |
| Chimp 9 | — | — | 7/24/80 | — | — | HBV |
| | 0.019 | 0.050 | | 8/22–10/10/79 | — | |
| | — | — | | 3/11/81 | 57 | |
| | 0.015 | 0.04 | | 7/01–8/05/81 | 9 | |
| | 0.008 | 0.02 | | 10/01/81 | 6 | |

TABLE 6-continued

Chimpanzee Serum Samples

| | OD | S/CO | Inoculation Date | Bleed Date | ALT (IU/L) | Transfused |
|---|---|---|---|---|---|---|
| Chimp 10 | — | — | 5/12/82 | — | — | HBV |
| | 0.011 | 0.03 | | 4/21–5/12/82 | 9 | |
| | 0.015 | 0.04 | | 9/01–9/08/82 | 126 | |
| | 0.008 | 0.02 | | 12/02/82 | 9 | |
| | 0.010 | 0.02 | | 1/06/83 | 13 | |
| Chimp 11 | — | — | 5/12/82 | — | — | HBV |
| | 0.000 | 0.00 | | 1/06–5/12/82 | 11 | |
| | — | — | | 6/23/82 | 100 | |
| | −0.003 | 0.00 | | 6/09–7/07/82 | — | |
| | −0.003 | 0.00 | | 10/28/82 | 9 | |
| | −0.003 | 0.00 | | 12/20/82 | 10 | |

IV.I.1.c. Panel 1: Proven Infectious Sera from Chronic Human NANBH Carriers

A coded panel consisted of 22 unique samples, each one in duplicate, for a total of 44 samples. The samples were from proven infectious sera from chronic NANBH carriers, infectious sera from implicated donors, and infectious sera from acute phase NANBH patients. In addition, the samples were from highly pedigreed negative controls, and other disease controls. This panel was provided by Dr. H. Alter of the Department of Health and Human Services, National Institutes of Health, Bethesda, Md. The panel was constructed by Dr. Alter several years ago, and has been used by Dr. Alter as a qualifying panel for putative NANBH assays.

The entire panel was assayed twice with the ELISA assay, and the results were sent to Dr. Alter to be scored. The results of the scoring are shown in Table 7. Although the Table reports the results of only one set of duplicates, the same values were obtained for each of the duplicate samples.

As shown in Table 7, 6 sera which were proven infectious in a chimpanzee model were strongly positive. The seventh infectious serum corresponded to a sample for an acute NANBH case, and was not reactive in this ELISA. A sample from an implicated donor with both normal ALT levels and equivocal results in the chimpanzee studies was non-reactive in the assay. Three other serial samples from one individual with acute NANBH were also non-reactive. All samples coming from the highly pedigreed negative controls, obtained from donors who had at least 10 blood donations without hepatitis implication, were non-reactive in the ELISA. Finally, four of the samples tested had previously scored as positive in putative NANBH assays developed by others, but these assays were not confirmable. These four samples scored negatively with the HCV ELISA.

TABLE 7

H. Alter's Panel 1:

| Panel | 1st Result | 2nd Result |
|---|---|---|
| 1) Proven Infectious by Chimpanzee Transmission A. Chronic NANB; Post-Tx | | |
| JF | + | + |
| EB | + | + |
| PG | + | + |
| B. Implicated Donors with Elevated ALT | | |
| BC | + | + |
| JJ | + | + |
| BB | + | + |
| C. Acute NANB; Post-Tx | | |
| WH | − | − |
| 2) Equivocally Infectious by Chimpanzee Transmission A. Implicated Donor with Normal ALT | | |
| CC | − | − |
| 3) Acute NANB; Post-Tx | | |
| JL Week 1 | − | − |
| JL Week 2 | − | − |
| JL Week 3 | − | − |
| 4) Disease Controls A. Primary Biliary Cirrhosis | | |
| EK | − | − |
| B. Alcoholic Hepatitis in Recovery | | |
| HB | − | − |
| 5) Pedigreed Negative Controls | | |
| DH | − | − |
| DC | − | − |
| LV | − | − |
| ML | − | − |
| AH | − | − |
| 6) Potential NANB "Antigens" | | |
| JS-80-01T-0 (Ishida) | − | − |
| Asterix (Trepo) | − | − |
| Zurtz (Arnold) | − | − |
| Becassdine (Trepo) | − | − |

IV.I.1.d. Panel 2: Donor/Recipient NANBH

The coded panel consisted of 10 unequivocal donor-recipient cases of transfusion associated NANBH, with a total of 188 samples. Each case consisted of samples of some or all the donors to the recipient, and of serial samples (drawn 3, 6, and 12 months after transfusion) from the recipient. Also included was a pre-bleed, drawn from the recipient before transfusion. The coded panel was provided by Dr. H. Alter, from the NIH, and the results were sent to him for scoring.

The results, which are summarized in Table 8, show that the ELISA detected antibody seroconversion in 9 of 10 cases of transfusion associated NANBH. Samples from case 4 (where no seroconversion was detected), consistently reacted poorly in the ELISA. Two of the 10 recipient samples were reactive at 3 months post transfusion. At six months, 8 recipient samples were reactive; and at twelve months, with the exception of case 4, all samples were reactive. In addition, at least one antibody positive donor was found in 7 out of the 10 cases, with case 10 having two positive donors. Also, in case 10, the recipient's pre-bleed was positive for HCV antibodies. The one month bleed from this recipient dropped to borderline reactive levels, while it was elevated to positive at 4 and 10 month bleeds. Generally, a S/CO of 0.4 is considered positive. Thus, this case may represent a prior infection of the individual with HCV.

The ALT and HBc status for all the reactive, i.e., positive, samples are summarized in Table 9. As seen in the table, ⅛ donor samples was negative for the surrogate markers and reactive in the HCV antibody ELISA. On the other hand, the recipient samples (followed up to 12 months after transfusion) had either elevated ALT, positive Anti-HBc, or both.

TABLE 8

H. Alter Donor/Recipient NANB Panel

| Case | Donor OD | Donor S/CO | Recipient Prebleed OD | Recipient Prebleed S/CO | 3 Months OD | 3 Months S/CO | Post TX 6 Months OD | Post TX 6 Months S/CO | 12 Months OD | 12 Months S/CO |
|---|---|---|---|---|---|---|---|---|---|---|
| 1. | — | — | .032 | 0.07 | .112 | 0.26 | >3.000 | >6.96 | >3.000 | >6.96 |
| 2. | — | — | .059 | 0.14 | .050 | 0.12 | 1.681 | 3.90 | >3.000 | >6.96 |
| 3. | .403 | 0.94 | .049 | 0.11 | .057 | 0.13 | >3.000 | >6.96 | >3.000 | >6.96 |
| 4. | — | — | .065 | 0.15 | .073 | 0.17 | .067 | 0.16 | .217 | 0.50 |
| 5. | >3.000 | >6.96 | .034 | 0.08 | .096 | 0.22 | >3.000 | >6.96 | >3.000 | >6.96 |
| 6. | >3.000 | >6.96 | .056 | 0.13 | 1.475 | 3.44 | >3.000 | >6.96 | >3.000 | >6.96 |
| 7. | >3.000 | >6.96 | .034 | 0.08 | .056 | 0.13 | >3.000 | >6.96 | >.3.000 | >6.96 |
| 8. | >3.000 | >6.96 | .061 | 0.14 | .078 | 0.18 | 2.262 | 5.28 | >3.000 | >6.96 |
| 9. | >3.000 | >6.96 | .080 | 0.19 | .127 | 0.30 | .055 | 0.13 | >3.000 | >6.96 |
| 10. | >3.000 | >6.96 | >3.000 | >6.96 | .317* | 0.74 | >3.000** | >6.96 | >3.000*** | >6.96 |
|  | >3.000 | >6.96 |  |  |  |  |  |  |  |  |

*1 Month,
**4 Months,
***10 Months

TABLE 9

ALT AND HBc STATUS FOR REACTIVE SAMPLES IN
H. ALTER PANEL 1

| Samples | Anti-ALT* | HBc** |
|---|---|---|
| Donors | | |
| Case 3 | Normal | Negative |
| Case 5 | Elevated | Positive |
| Case 6 | Elevated | Positive |
| Case 7 | Not Available | Negative |
| Case 8 | Normal | Positive |
| Case 9 | Elevated | Not Available |
| Case 10 | Normal | Positive |
| Case 10 | Normal | Positive |
| Recipients | | |
| Case 1 | 6 mo | Elevated | Positive |
|  | 12 mo | Elevated | Not tested |

TABLE 9-continued

ALT AND HBc STATUS FOR REACTIVE SAMPLES IN
H. ALTER PANEL 1

|  | Samples | Anti-ALT* | HBc** |
|---|---|---|---|
| Case 2 | 6 mo | Elevated | Negative |
|  | 12 mo | Elevated | Negative |
| Case 3 | 6 mo | Normal | Not tested*** |
|  | 12 mo | Elevated | Not tested*** |
| Case 5 | 6 mo | Elevated | Not tested |
|  | 12 mo | Elevated | Not tested |
| Case 6 | 3 mo | Elevated | Negative |
|  | 6 mo | Elevated | Negative |
|  | 12 mo | Elevated | Not tested |
| Case 7 | 6 mo | Elevated | Negative |
|  | 12 mo | Elevated | Negative |
| Case 8 | 6 mo | Normal | Positive |
|  | 12 mo | Elevated | Not tested |
| Case 9 | 12 mo | Elevated | Not tested |
| Case 10 | 4 mo | Elevated | Not tested |
|  | 10 mo | Elevated | Not tested |

*ALT ≧ 45 IU/L is above normal limits
**Anti-HBc ≦ 50% (competition assay) is considered positive.
***Prebleed and 3 mo samples were negative for HBc.

IV.I.1.e. Determination of HCV Infection in High Risk Group Samples

Samples from high risk groups were monitored using the ELISA to determine reactivity to HCV c100-3 antigen. These samples were obtained from Dr. Gary Tegtmeier, Community Blood Bank, Kansas City. The results are summarized in Table 10.

As shown in the table, the samples with the highest reactivity are obtained from hemophiliacs (76%). In addition, samples from individuals with elevated ALT and positive for Anti-HBc, scored 51% reactive, a value which is consistent with the value expected from clinical data and NANBH prevalence in this group. The incidence of antibody to HCV was also higher in blood donors with elevated ALT alone, blood donors positive for antibodies to Hepatitis B core alone, and in blood donors rejected for reasons other than high ALT or anti-core antibody when compared to random volunteer donors.

TABLE 10

NANBH HIGH RISK GROUP SAMPLES

| Group | N | Distribution N | OD | % Reactive |
|---|---|---|---|---|
| Elevated ALT | 35 | 3 | >3.000 | 11.4% |
|  |  | 1 | 0.728 |  |
| Anti-HBc | 24 | 5 | >3.000 | 20.8% |
| Elevated ALT, Anti-HBc | 33 | 12 | >3.000 | 51.5% |
|  |  | 1 | 2.768 |  |
|  |  | 1 | 2.324 |  |
|  |  | 1 | 0.939 |  |
|  |  | 1 | 0.951 |  |
|  |  | 1 | 0.906 |  |
| Rejected Donors | 25 | 5 | >3.000 | 20.0% |
| Donors with History of Hepatitis | 150 | 19 | >3.000 | 14.7% |
|  |  | 1 | 1.837 |  |
|  |  | 1 | 0.714 |  |
|  |  | 1 | 0.469 |  |
| Hemophiliacs | 50 | 31 | >3.000 | 76.0% |
|  |  | 1 | 2.568 |  |
|  |  | 1 | 2.483 |  |
|  |  | 1 | 2.000 |  |
|  |  | 1 | 1.979 |  |
|  |  | 1 | 1.495 |  |
|  |  | 1 | 1.209 |  |
|  |  | 1 | 0.819 |  |

IV.I.1.f.(1) Comparative Studies Using Anti-IgG or Anti-IgM Monoclonal Antibodies, or Polyclonal Antibodies as a Second Antibody in the HCV c100-3 ELISA The sensitivity of the ELISA determination which uses the anti-IgG monoclonal conjugate was compared to that obtained by using either an anti-IgM monoclonal conjugate, or by replacing both with a polyclonal antiserum reported to be both heavy and light chain specific. The following studies were performed.

IV.1.6.a. Serial Samples from Seroconverters

Serial samples from three cases of NANB seroconverters were studied in the HCV c100-3 ELISA assay using in the enzyme conjugate either the anti-IgG monoclonal alone, or in combination with an anti-IgM monoclonal, or using a polyclonal antiserum. The samples were provided by Dr. Cladd Stevens, N.Y. Blood Center, N.Y.C., N.Y. The sample histories are shown in Table 11.

The results obtained using an anti-IgG monoclonal antibody-enzyme conjugate are shown in Table 12. The data shows that strong reactivity is initially detected in samples 1-4, 2-8, and 3-5, of cases 1, 2, and 3, respectively.

The results obtained using a combination of an anti-IgG monoclonal conjugate and an anti-IgM conjugate are shown in Table 13. Three different ratios of anti-IgG to anti-IgM were tested; the 1:10,000 dilution of anti-IgG was constant throughout. Dilutions tested for the anti-IgM monoclonal conjugate were 1:30,000, 1:60,000, and 1:120,000. The data shows that, in agreement with the studies with anti-IgG alone, initial strong reactivity is detected in samples 1-4, 2-8, and 3-5.

The results obtained with the ELISA using anti-IgG monoclonal conjugate (1:10,000 dilution), or Tago polyclonal conjugate (1:80,000 dilution), or Jackson polyclonal conjugate (1:80,000 dilution) are shown in Table 14. The data indicates that initial strong reactivity is detected in samples 1-4, 2-8, and 3-5 using all three configurations; the Tago polyclonal antibodies yielded the lowest signals.

The results presented above show that all three configurations detect reactive samples at the same time after the acute phase of the disease (as evidenced by the ALT elevation). Moreover, the results indicate that the sensitivity of the HCV c100-3 ELISA using anti-IgG monoclonal-enzyme conjugate is equal to or better than that obtained using the other tested configurations for the enzyme conjugate.

TABLE 11

DESCRIPTION OF SAMPLES FROM CLADD STEVENS PANEL

| | Date | HBsAg | Anti-HBs | Anti-HBc | ALT | Bilirubin |
|---|---|---|---|---|---|---|
| Case 1 | | | | | | |
| 1-1 | 8/5/81 | 1.0 | 91.7 | 12.9 | 40.0 | −1.0 |
| 1-2 | 9/2/81 | 1.0 | 121.0 | 15.1 | 274.0 | 1.4 |
| 1-3 | 10/7/81 | 1.0 | 64.0 | 23.8 | 261.0 | 0.9 |
| 1-4 | 11/19/81 | 1.0 | 67.3 | 33.8 | 75.0 | 0.9 |
| 1-5 | 12/15/81 | 1.0 | 50.5 | 27.6 | 71.0 | 1.0 |
| Case 2 | | | | | | |
| 2-1 | 10/19/81 | 1.0 | 1.0 | 116.2 | 17.0 | −1.0 |
| 2-2 | 11/18/81 | 1.0 | 0.8 | 89.5 | 46.0 | 1.1 |
| 2-3 | 12/02/81 | 1.0 | 1.2 | 78.3 | 63.0 | 1.4 |
| 2-4 | 12/14/81 | 1.0 | 0.9 | 90.6 | 152.0 | 1.4 |
| 2-5 | 12/23/81 | 1.0 | 0.8 | 93.6 | 624.0 | 1.7 |
| 2-6 | 1/20/82 | 1.0 | 0.8 | 92.9 | 66.0 | 1.5 |
| 2-7 | 2/15/82 | 1.0 | 0.8 | 86.7 | 70.0 | 1.3 |
| 2-8 | 3/17/82 | 1.0 | 0.9 | 69.8 | 24.0 | −1.0 |
| 2-9 | 4/21/82 | 1.0 | 0.9 | 67.1 | 53.0 | 1.5 |
| 2-10 | 5/19/82 | 1.0 | 0.5 | 74.8 | 95.0 | 1.6 |
| 2-11 | 6/14/82 | 1.0 | 0.8 | 82.9 | 37.0 | −1.0 |
| Case 3 | | | | | | |
| 3-1 | 4/7/81 | 1.0 | 1.2 | 88.4 | 13.0 | −1.0 |
| 3-2 | 5/12/81 | 1.0 | 1.1 | 126.2 | 236.0 | 0.4 |
| 3-3 | 5/30/81 | 1.0 | 0.7 | 99.9 | 471.0 | 0.2 |
| 3-4 | 6/9/81 | 1.0 | 1.2 | 110.8 | 315.0 | 0.4 |
| 3-5 | 7/6/81 | 1.0 | 1.1 | 89.9 | 273.0 | 0.4 |
| 3-6 | 8/10/81 | 1.0 | 1.0 | 118.2 | 158.0 | 0.4 |
| 3-7 | 9/8/81 | 1.0 | 1.0 | 112.3 | 84.0 | 0.3 |
| 3-8 | 10/14/81 | 1.0 | 0.9 | 102.5 | 180.0 | 0.5 |
| 3-9 | 11/1/81 | 1.0 | 1.0 | 84.6 | 154.0 | 0.3 |

TABLE 12

ELISA RESULTS OBTAINED USING AN ANTI-IgG MONOCLONAL CONJUGATE

| SAMPLE | DATE | ALT | OD | S/CO |
|---|---|---|---|---|
| Neg Control | | | .076 | |
| Cutoff | | | .476 | |
| PC (1:128) | | | 1.390 | |
| Case #1 | | | | |
| 1-1 | 08/05/81 | 40.0 | .178 | .37 |
| 1-2 | 09/02/81 | 274.0 | .154 | .32 |
| 1-3 | 10/07/81 | 261.0 | .129 | .27 |
| 1-4 | 11/19/91 | 75.0 | .937 | 1.97 |
| 1-5 | 12/15/81 | 71.0 | >3.000 | >6.30 |
| Case #2 | | | | |
| 2-1 | 10/19/81 | 17.0 | .058 | 0.12 |
| 2-2 | 11/17/81 | 46.0 | .050 | 0.11 |
| 2-3 | 12/02/81 | 63.0 | .047 | 0.10 |
| 2-4 | 12/14/81 | 152.0 | .059 | 0.12 |
| 2-5 | 12/23/81 | 624.0 | .070 | 0.15 |
| 2-6 | 01/20/82 | 66.0 | .051 | 0.11 |
| 2-7 | 02/15/82 | 70.0 | .139 | 0.29 |
| 2-8 | 03/17/82 | 24.0 | 1.867 | 3.92 |
| 2-9 | 04/21/82 | 53.0 | >3.000 | >6.30 |
| 2-10 | 05/19/82 | 95.0 | >3.000 | >6.30 |
| 2-11 | 06/14/82 | 37.0 | >3.000 | >6.30 |
| Case #3 | | | | |
| 3-1 | 04/07/81 | 13.0 | .090 | .19 |
| 3-2 | 05/12/81 | 236.0 | .064 | .13 |
| 3-3 | 05/30/81 | 471.0 | .079 | .17 |

TABLE 12-continued

ELISA RESULTS OBTAINED USING AN ANTI-IgG MONOCLONAL CONJUGATE

| SAMPLE | DATE | ALT | OD | S/CO |
|---|---|---|---|---|
| 3-4 | 06/09/81 | 315.0 | .211 | .44 |
| 3-5 | 07/06/81 | 273.0 | 1.707 | 3.59 |
| 3-6 | 08/10/81 | 158.0 | >3.000 | >6.30 |
| 3-7 | 09/08/81 | 84.0 | >3.000 | >6.30 |
| 3-8 | 10/14/81 | 180.0 | >3.000 | >6.30 |
| 3-9 | 11/11/81 | 154.0 | >3.000 | >6.30 |

TABLE 13

ELISA RESULTS OBTAINED USING ANTI-IgG and ANTI-IgM MONOCLONAL CONJUGATE NANB ELISAs

| | | | Monoclonals IgM 1:10K IgM 1:30K | | Monoclonals IgM 1:10K IgM 1:60K | | Monoclonals IgM 1:10K IgM 1:120K | |
|---|---|---|---|---|---|---|---|---|
| SAMPLE | DATE | ALT | OD | S/CO | OD | S/CO | OD | S/CO |
| Neg Control Cutoff | | | .100 | | .080 | | .079 | |
| PC(1:128) | | | 1.083 | | 1.328 | | 1.197 | |
| Case #1 | | | | | | | | |
| 1-1 | 08/05/81 | 40 | .173 | | .163 | | .070 | |
| 1-2 | 09/02/81 | 274 | .194 | | .141 | | .079 | |
| 1-3 | 10/07/81 | 261 | .162 | | .129 | | .163 | |
| 1-4 | 11/19/91 | 75 | .812 | | .85 | | .709 | |
| 1-5 | 12/15/81 | 71 | >3.00 | | >3.00 | | >3.00 | |
| Case #2 | | | | | | | | |
| 2-1 | 10/19/81 | 17 | .442 | | .045 | | .085 | |
| 2-2 | 11/17/81 | 46 | .102 | | .029 | | .030 | |
| 2-3 | 12/02/81 | 63 | .059 | | .036 | | .027 | |
| 2-4 | 12/14/81 | 152 | .065 | | .041 | | .025 | |
| 2-5 | 12/23/81 | 624 | .082 | | .033 | | .032 | |
| 2-6 | 01/20/82 | 66 | .102 | | .042 | | .027 | |
| 2-7 | 02/15/82 | 70 | .188 | | .068 | | .096 | |
| 2-8 | 03/17/82 | 24 | 1.728 | | 1.668 | | 1.541 | |
| 2-9 | 04/21/82 | 53 | >3.00 | 2.443 | >3.00 | | | |
| 2-10 | 05/19/82 | 95 | >3.00 | | >3.00 | | >3.00 | |
| 2-11 | 06/14/82 | 37 | >3.00 | | >3.00 | | >3.00 | |
| Case #3 | | | | | | | | |
| 3-1 | 04/07/81 | 13 | .193 | | .076 | | .049 | |
| 3-2 | 05/12/81 | 236 | .201 | | .051 | | .038 | |
| 3-3 | 05/30/81 | 471 | .132 | | .067 | | .052 | |
| 3-4 | 06/09/81 | 315 | .175 | | .155 | | .140 | |
| 3-5 | 07/06/81 | 273 | 1.335 | | 1.238 | | 1.260 | |
| 3-6 | 08/10/81 | 158 | >3.00 | | >3.00 | | >3.00 | |
| 3-7 | 09/08/81 | 84 | >3.00 | | >3.00 | | >3.00 | |
| 3-8 | 10/14/81 | 180 | >3.00 | | >3.00 | | >3.00 | |
| 3-9 | 11/11/81 | 154 | >3.00 | | >3.00 | | >3.00 | |

TABLE 14

ELISA RESULTS OBTAINED USING POLYCLONAL CONJUGATES NANB ELISAs

| | | | Monoclonals 1:10K | | Tago 1:80K | | Jackson 1:80K | |
|---|---|---|---|---|---|---|---|---|
| SAMPLE | DATE | ALT | OD | S/CO | OD | S/CO | OD | S/CO |
| Neg Control | | | .076 | | .045 | | .154 | |
| Cutoff | | | .476 | | .545 | | .654 | |
| PC(1:128) | | | 1.390 | | .727 | | 2.154 | |

TABLE 14-continued

ELISA RESULTS OBTAINED USING POLYCLONAL CONJUGATES NANB ELISAs

| | | | Monoclonals 1:10K | | Tago 1:80K | | Jackson 1:80K | |
|---|---|---|---|---|---|---|---|---|
| SAMPLE | DATE | ALT | OD | S/CO | OD | S/CO | OD | S/CO |
| Case #1 | | | | | | | | |
| 1-1 | 08/05/81 | 40 | .178 | .37 | .067 | .12 | .153 | .23 |
| 1-2 | 09/02/81 | 274 | .154 | .32 | .097 | .18 | .225 | .34 |
| 1-3 | 10/07/81 | 261 | .129 | .27 | .026 | .05 | .167 | .26 |
| 1-4 | 11/19/91 | 75 | .937 | 1.97 | .324 | .60 | .793 | 1.21 |
| 1-5 | 12/15/81 | 71 | >3.00 | >6.30 | 1.778 | 3.27 | >3.00 | >4.29 |
| Case #2 | | | | | | | | |
| 2-1 | 10/19/81 | 17 | .058 | .12 | .023 | .04 | .052 | .08 |
| 2-2 | 11/17/81 | 46 | .050 | .11 | .018 | .03 | .058 | .09 |
| 2-3 | 12/02/81 | 63 | .047 | .10 | .020 | .04 | .060 | .09 |
| 2-4 | 12/14/81 | 152 | .059 | .12 | .025 | .05 | .054 | .08 |
| 2-5 | 12/23/81 | 624 | .070 | .15 | .026 | .05 | .074 | .11 |
| 2-6 | 01/20/82 | 66 | .051 | .11 | .018 | .03 | .058 | .09 |
| 2-7 | 02/15/82 | 70 | .139 | .29 | .037 | .07 | .146 | .22 |
| 2-8 | 03/17/82 | 24 | 1.867 | 3.92 | .355 | .65 | 1.429 | 2.19 |
| 2-9 | 04/21/82 | 53 | >3.00 | >6.30 | .748 | 1.37 | >3.00 | >4.59 |
| 2-10 | 05/19/82 | 95 | >3.00 | >6.30 | 1.025 | 1.88 | >3.00 | >4.59 |
| 2-11 | 06/14/82 | 37 | >3.00 | >6.30 | .917 | 1.68 | >3.00 | >4.59 |
| Case #3 | | | | | | | | |
| 3-1 | 04/07/81 | 13 | .090 | .19 | .049 | .09 | .138 | .21 |
| 3-2 | 05/12/81 | 236 | .064 | .13 | .040 | .07 | .094 | .14 |
| 3-3 | 05/30/81 | 471 | .079 | .17 | .045 | .08 | .144 | .22 |
| 3-4 | 06/09/81 | 315 | .211 | .44 | .085 | .16 | .275 | .42 |
| 3-5 | 07/06/81 | 273 | 1.707 | 3.59 | .272 | .50 | 1.773 | 2.71 |
| 3-6 | 08/10/81 | 158 | >3.00 | >6.30 | 1.347 | 2.47 | >3.00 | >4.59 |
| 3-7 | 09/08/81 | 84 | >3.00 | >6.30 | 2.294 | 4.21 | >3.00 | >4.59 |
| 3-8 | 10/14/81 | 180 | >3.00 | >6.30 | >3.00 | >5.50 | >3.00 | >4.59 |
| 3-9 | 11/11/81 | 154 | >3.00 | >6.30 | >3.00 | >5.50 | >3.00 | >4.59 |

IV.I.1.f.(2). Samples from Random Blood Donors

Figure 44:
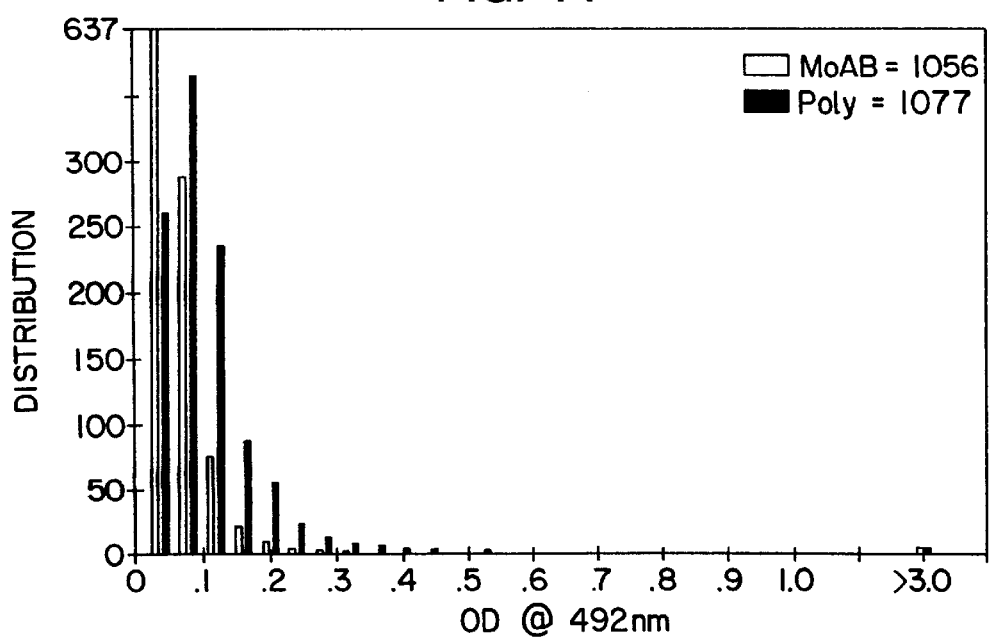
FIG. 44 shows a histogram of the distribution of HCV infection in random samples using two configurations of immunoglobulin-enzyme conjugate in an ELISA assay.
Figure 55A:
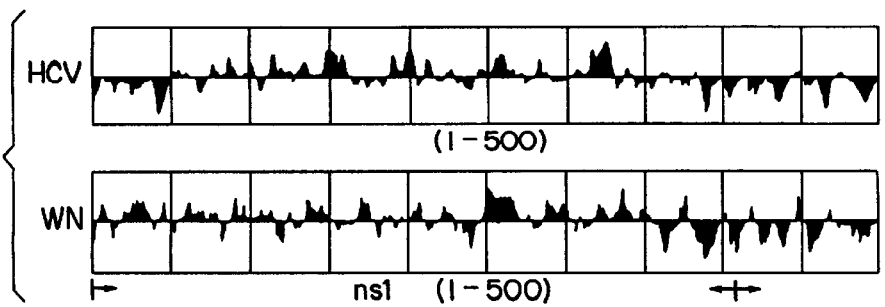
FIG. 55 shows the hydrophobicity profiles of polyproteins encoded in HCV and in West Nile virus.
Figure 55B:
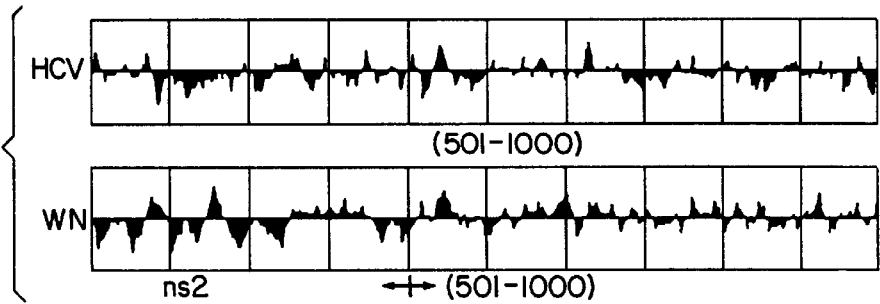
Figure 55C:
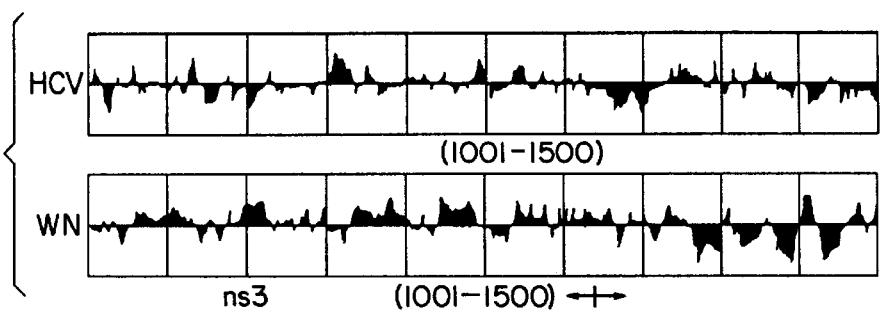
Figure 55D:
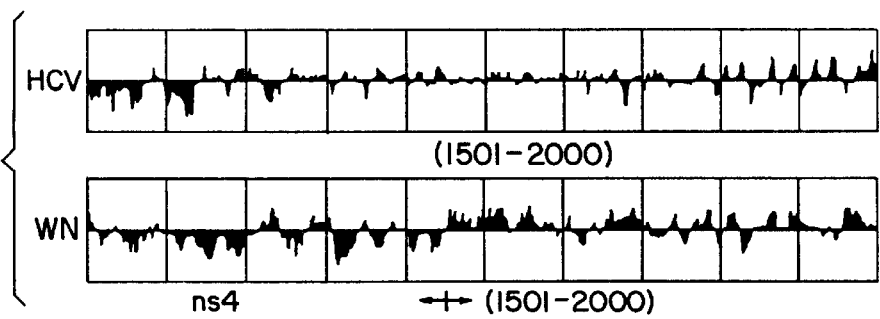
Figure 55E:
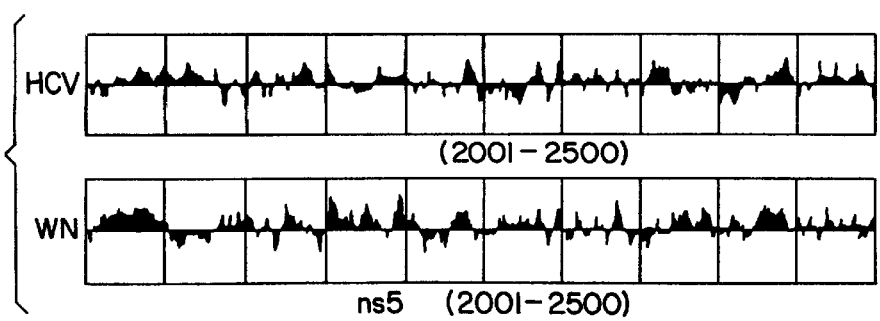

Samples from random blood donors (see Section IV.I.1.) were screened for HCV infection using the HCV c100-3 ELISA, in which the antibody-enzyme conjugate was either an anti-IgG monoclonal conjugate, or a polyclonal conjugate. The total number of samples screened were 1077 and 1056, for the polyclonal conjugate and the monoclonal conjugate, respectively. A summary of the results of the screening is shown in Table 15, and the sample distributions are shown in the histogram in FIG. 44.

The calculation of the average and standard deviation was performed excluding samples that gave a signal over 1.5, i.e., 1073 OD values were used for the calculations utilizing the polyclonal conjugate, and 1051 for the anti-IgG monoclonal conjugate. As seen in Table 15, when the polyclonal conjugate was used, the average was shifted from 0.0493 to 0.0931, and the standard deviation was increased from 0.074 to 0.0933. Moreover, the results also show that if the criteria of x +5SD is employed to define the assay cutoff, the polyclonal-enzyme conjugate configuration in the ELISA requires a higher cutoff value. This indicates a reduced assay specificity as compared to the monoclonal system. In addition, as depicted in the histogram in FIG. 44, a greater separation of results between negative and positive distributions occurs when random blood donors are screened in an ELISA using the anti-IgG monoclonal conjugate as compared to the assay using a commercial polyclonal label.

TABLE 15

COMPARISON OF TWO ELISA CONFIGURATIONS IN
TESTING SAMPLES FROM RANDOM BLOOD DONORS

| CONJUGATE | POLYCLONAL (Jackson) | ANTI-IgG MONOCLONAL |
|---|---|---|
| Number of samples | 1073 | 1051 |
| Average (x) | 0.0931 | 0.04926 |
| Standard deviation (SD) | 0.0933 | 0.07427 |
| 5 SD | 0.4666 | 0.3714 |
| CUT-OFF (5 SD + x) | 0.5596 | 0.4206 |

IV.I.2. ELISA Assay Using Recombinant SOD-NANB$_{5\text{-}1\text{-}1}$

This assay utilizes the SOD-NANB$_{5\text{-}1\text{-}1}$ antigen, and is similar to the assay utilizing the c100-3 antigen (see Section IV.I.1.) except for the following.

The HCV polypeptide used in the assay is SOD-NANB$_{5\text{-}1\text{-}1}$ which is purified as described in Section IV.N.1.b., infra.

In the preparation of the plates, Immulon 2 plates replace Immulon 1 plates. In addition, BSA is omitted from the coating solution, and the coating solution contains 3.75 mg/mL of SOD-NANB$_{5\text{-}1\text{-}1}$ instead of c100-3.

The assay is also changed in that the sample diluent contains 1 mg/mL yeast extract, and also contains 500 mg/mL of the second E. coli extract (which comprised proteins in the soluble fraction of the lysozyme treated bacteria), and 100 mg/mL SOD. The extracts are prepared as described in Section IV.N.1.a., infra.

IV.I.3. ELISA Assay Using Recombinant C33c

This assay utilizes the SOD-C33c antigen, and is similar to the assay utilizing the SOD-NANB$_{5\text{-}1\text{-}1}$ antigen (see Section IV.I.2.) except for the following.

The HCV polypeptide used in the assay is SOD-C33c, which is prepared as described in Section IV.B.9., supra. The plates coated are Immulon 1 plates instead of Immulon 2 plates, and the coating solution 1.25 mg/mL of SOD-C33c instead of c100-3. The assay is also changed in that the sample diluent contains 1 mg/mL yeast extract instead of 100 mg/mL of the second E. coli extract and 100 mg/mL of SOD.

IV.I.4. ELISA Assay Using a Synthetic Polypeptide Containing NANB$_{5\text{-}1\text{-}1}$ Sequences This assay utilizes a synthetic peptide containing 42 amino acids encoded in HCV which are in the NANB$_{5\text{-}1\text{-}1}$ polypeptide, and which are also in the c100-3 polypeptide. The polypeptide, which was prepared by Peninsula Laboratory sing chemical synthesis, has the following sequence.

NH$_2$-Ile-Ile-Pro-Asp-Arg-Glu-Val-Leu-Tyr-Arg-Glu-Phe-Asp-Glu-Met-Glu-Glu-Cys-Ser-Gln-His-Leu-Pro-Tyr-Ile-Glu-Gln-Met-Met-Leu-Ala-Glu-Gln-Phe-Lys-Gln-Lys-Ala-Leu-Gly-Leu-COOH. (SEQ ID NO:771)

The assay is essentially as described in Section IV.I.1., except that the synthetic 5-1-1 polypeptide replaces the c100-3 polypeptide in the coating solution at a concentration of 2.5 mg/mL. Also, Immulon 2 plates replace Immulon 1 plates, and the BSA is omitted from the coating solution.

IV.J. Detection of HCV Seroconversion in NANBH Patients from a Variety of Geographical Locations Sera from patients who were suspected to have NANBH based upon elevated ALT levels, and who were negative in HAV and HBV tests were screened using the RIA essentially as described in Section IV.D., except that the HCV C100-3 antigen was used as the screening antigen in the microtiter plates. As seen from the results presented in Table 16, the RIA detected positive samples in a high percentage of the cases.

TABLE 16

Seroconversion Frequencies for Anti-c100-3
Among NANBH Patients in Different Countries

| Country | The Netherlands | Italy | Japan |
|---|---|---|---|
| No. Examined | 5 | 36 | 26 |
| No. Positive | 3 | 29 | 19 |
| % Positive | 60 | 80 | 73 |

IV.K. Detection of HCV Seroconversion in Patients with "Community Acquired" NANBH Sera which was obtained from 100 patients with NANBH, for whom there was no obvious transmission route (i.e., no transfusions, i.v. drug use, promiscuity, etc. were identified as risk factors), was provided by Dr. M. Alter of the Center for Disease Control, and Dr. J. Dienstag of Harvard University. These samples were screened using an RIA essentially as described in Section IV.D., except that the HCV c100-3 antigen was used as the screening antigen attached to the microtiter plates. The results showed that of the 100 serum samples, 55 contained antibodies that reacted immunologically with the HCV c100-3 antigen.

The results described above suggest that "Community Acquired" NANBH is also caused by HCV. Moreover, since it has been demonstrated herein that HCV is related to Flaviviruses, most of which are transmitted by arthropods, it is suggestive that HCV transmission in the "Community Acquired" cases also results from arthropod transmission.

IV.L. Comparison of Incidence of HCV Antibodies and Surrogate Markers in Donors Implicated in NANBH Transmission A prospective study was carried out to determine whether recipients of blood from suspected NANBH positive donors, who developed NANBH, seroconverted to anti-HCV-antibody positive. The blood donors were tested for the surrogate marker abnormalities which are currently used as markers for NANBH infection, i.e., elevated ALT levels, and the presence of anti-core antibody. In addition, the donors were also tested for the presence of anti-HCV antibodies. The determination of the presence of anti-HCV antibodies was determined using a radioimmunoassay as described in Section IV.K. The results of the study are presented in Table 17, which shows: the patient number (column 1); the presence of anti-HCV antibodies in patient serum (column 2); the number of donations received by the patient, with each donation being from a different donor (column 3); the presence of anti-HCV antibodies in donor serum (column 4); and the surrogate abnormality of the donor (column 5) (NT or—means not tested) (ALT is elevated transaminase, and ANTI-HBc is anti-core antibody).

The results in Table 17 demonstrate that the HCV antibody test is more accurate in detecting infected blood donors than are the surrogate marker tests. Nine out of ten patients who developed NANBH symptoms tested positive for anti-HCV antibody seroconversion. Of the 11 suspected donors, (patient 6 received donations from two different individuals suspected of being NANBH carriers), 9 were positive for anti-HCV antibodies, and 1 was borderline positive, and therefore equivocal (donor for patient 1). In contrast, using the elevated ALT test 6 of the ten donors tested negative, and using the anticore-antibody test 5 of the ten donors tested negative. Of greater consequence, though, in three cases (donors to patients 8, 9, and 10) the ALT test and the ANTI-HBc test yielded inconsistent results.

TABLE 17

Development of Anti-HCV Antibodies in Patients Receiving Blood From Donors Suspected Of Being NANBH Carriers

| Patient | Anti-HCV Seroconversion in Patient | No. of Donations/ Donors | Anti-HCV Positive Donor | Surrogate Abnormality* | |
|---|---|---|---|---|---|
| | | | | Alt | Anti-HBc |
| 1 | yes | 18 | equiv | no | no |
| 2 | yes | 18 | yes | NT | yes |
| 3 | yes | 13 | yes | no | no |
| 4 | no | 18 | no | — | — |
| 5 | yes | 16 | yes | yes | yes |
| 6 | yes | 11 | yes(2) | no | no |
| | | | | yes | yes |
| 7 | yes | 15 | yes | NT | no |
| 8 | yes | 20 | yes | no | yes |
| 9 | yes | 5 | yes | yes | no |
| 10 | yes | 15 | yes | no | yes |

*Same donor as anti-NANBV Positive

IV.M. Amplification for Cloning of HCV cDNA Sequences Utilizing the PCR and Primers Derived from Conserved Regions of Flavivirus Genomic Sequences The results presented supra, which suggest that HCV is a flavivirus or flavi-like virus, allows a strategy for cloning uncharacterized HCV cDNA sequences utilizing the PCR technique, and primers derived from the regions encoding conserved amino acid sequences in flaviviruses. Generally, one of the primers is derived from a defined HCV genomic sequence, and the other primer which flanks a region of unsequenced HCV polynucleotide is derived from a conserved region of the flavivirus genome. The flavivirus genomes are known to contain conserved sequences within the NS1, and E polypeptides, which are encoded in the 5'-region of the flavivirus genome. Corresponding sequences encoding these regions lie upstream of the HCV cDNA sequence shown in FIG. 26. Thus, to isolate cDNA sequences derived from this region of the HCV genome, upstream primers are designed which are derived from the conserved sequences within these flavivirus polypeptides. The downstream primers are derived from an upstream end of the known portion of the HCV cDNA.

Because of the degeneracy of the code, it is probable that there will be mismatches between the flavivirus probes and the corresponding HCV genomic sequence. Therefore a strategy which is similar to the one described by Lee (1988) is used. The Lee procedure utilizes mixed oligonucleotide primers complementary to the reverse translation products of an amino acid sequence; the sequences in the mixed primers takes into account every codon degeneracy for the conserved amino acid sequence.

Three sets of primer mixes are generated, based on the amino acid homologies found in several flaviviruses, including Dengue-2,4 (D-2,4), Japanese Encephalitis Virus (JEV), Yellow Fever (YF), and West Nile Virus (WN). The primer mixture derived from the most upstream conserved sequence (5'-1), is based upon the amino acid sequence Gly-Trp-Gly, which is part of the conserved sequence Asp-Arg-Gly-Trp-Gly-AspN (SEQ ID NO:772) found in the E protein of D-2, JEV, YF, and WN. The next primer mixture (5'-2) is based upon a downstream conserved sequence in E protein, Phe-Asp-Gly-Asp-Ser-Tyr-Ile-Phe-Gly-Asp-Ser-Tyr-Ile, (SEQ ID NO:773) and is derived from Phe-Gly-Asp; the conserved sequence is present in D-2, JEV, YF, and WN. The third primer mixture (5'-3), is based on the amino acid sequence Arg-Ser-Cys, which is part of the conserved sequence Cys-Cys-Arg-Ser-Cys (SEQ ID NO:774) in the NS1 protein of D-2, D-4, JEV, YF, and WN. The individual primers which form the mixture in 5'-3 are shown in FIG. 45. In addition to the varied sequences derived from conserved region, each primer in each mixture also contains a constant region at the 5'-end which contains a sequence encoding sites for restriction enzymes, HindIII, MboI, and EcoRI.

The downstream primer, ssc5h20A, is derived from a nucleotide sequence in clone 5h, which contains HCV cDNA with sequences with overlap those in clones 14i and 11b. The sequence of ssc5h20A is

5' GTA ATA TGG TGA CAG AGT CA 3' (SEQ ID NO:775).

An alternative primer, ssc5h34A, may also be used. This primer is derived from a sequence in clone 5h, and in addition contains nucleotides at the 5'-end which create a restriction enzyme site, thus facilitating cloning. The sequence of ssc5h34A is

5' GAT CTC TAG AGA AAT CAA TAT GGT GAC AGA GTC A 3' (SEQ ID NO:776).

The PCR reaction, which was initially described by Saiki et al. (1986), is carried out essentially as described in Lee et al. (1988), except that the template for the cDNA is RNA isolated from HCV infected chimpanzee liver, as described in Section IV.C.2., or from viral particles isolated from HCV infected chimpanzee serum, as described in Section IV.A.1. In addition, the annealing conditions are less stringent in the first round of amplification (0.6M NaCl, and 25° C.), since the part of the primer which will anneal to the HCV sequence is only 9 nucleotides, and there could be mismatches. Moreover, if ssc5h34A is used, the additional sequences not derived from the HCV genome tend to destabilize the primer-template hybrid. After the first round of amplification, the annealing conditions can be more stringent (0.066M NaCl, and 32° C.–37° C.), since the amplified sequences now contain regions which are complementary to, or duplicates of the primers. In addition, the first 10 cycles of amplification are run with Klenow enzyme I, under appropriate PCR conditions for that enzyme. After the completion of these cycles, the samples are extracted, and run with Taq polymerase, according to kit directions, as furnished by Cetus/Perkin-Elmer.

After the amplification, the amplified HCV cDNA sequences are detected by hybridization using a probe derived from clone 5h. This probe is derived from sequences upstream of those used to derive the primer, and does not overlap the sequences of the clone 5h derived primers. The sequence of the probe is 5' CCC AGC GGC GTA CGC GCT GGA CAC GGA GGT GGC
CGC GTC GTG TGG CGG TGT TGT TCT CGT CGG GTT
GAT GGC GC 3' (SEQ ID NO:777).

IV.N.1. Immunoblot Assay for HCV Antibodies Using HCV Antigens

The immunoblot assay for HCV employs an immunoblot ELISA technique for the qualitative detection of antibodies to HCV in biological specimens. The assay uses three purified recombinant antigens: the fusion polypeptide, SOD-NANB$_{5-1-1}$ (also called 5-1-1); the fusion polypeptide SOD-C33c; the fusion polypeptide HCV C100-3; and human superoxide dismutase (hSOD). The latter antigen is included as a control to detect the presence of antibodies against SOD. The purification procedure for SOD-NANB$_{5-1-1}$ is described below in Section IV.N.1.b.; that for the fusion C100-3 polypeptide is described in Section IV.B.7.b; and that for the C33c polypeptide is described in Section IV.B.9.

IV.N.1.a. The Immunoblot Assay System for HCV

In the immunoblot assay system for HCV, the above described individual recombinant derived HCV antigens are immobilized in discreet bands on nitrocellulose strips (0.45 mm) by vacuum blotting solutions of individual antigens. During the incubation of the strips with the biological specimens, antibodies to HCV, if present, react with the corresponding antigens coated in bands on the nitrocellulose strips. After the removal of nonspecific antibodies by aspiration and washing, the strip is then reacted with goat anti-human IgG (heavy and light chain specific) labeled with horseradish peroxidase (HRP). Following incubation, decantation, and washing to remove excess conjugate, 4-chloro-1-naphthol solution containing hydrogen peroxide is added. The corresponding intensities of the blue-black colored bands which develop are proportional to the amount of specific antibody bound to each of the recombinant proteins on the strips. After the precipitation reaction is stopped by decantation and washing, the reactivity of specimens towards each antigen is determined by visually comparing the intensity of the individual antigen band with that of the low and high IgG internal controls included on each strip.

The reagents utilized in the test are the following. The conjugate is goat anti-human IgG (heavy and light chain specific) labeled with HRP in sodium phosphate buffer containing sodium chloride and protein stabilizers. The stock substrate is 4-chloro-1-naphthol (3 g/L) in methanol. The developer buffer is sodium monobasic phosphate (1.3 g) containing sodium chloride (1.17 g/L) and hydrogen peroxide (1 mL/L). The developer buffer contains sodium monobasic phosphate (13.8 g/L), NaCl (29.2 g/L), casein (1 g/L), EDTA disodium salt (0.34 g/L), Triton X-100 (10 g/L), 10% thimerosal (1 mL/L), yeast extract (1 g/L), BSA (10 g/L), the first *E. coli* extract (20 mg/L) and the second *E. coli* extract (0.5 g/L). The HCV antibody positive control is inactivated human serum containing antibodies to HCV; the serum is inactivated by heat and psoralen treatment. The HCV antibody negative control is human serum which does not demonstrate antibodies to HCV. A working sample diluent for the assay is prepared by weighing out 0.5 gm nonfat dry milk powder into each 10 mL sample diluent, and mixing well before use. The working substrate for the assay is prepared by combining 1 part of the stock substrate with 5 parts of developer buffer.

The yeast extract used in the sample diluent is prepared as follows. Red Star baker's yeast (Universal Foods) is slurried with an approximately equal amount (weight to volume) of 64 mM Tris HCl, and the pH is adjusted to 7.0. The yeast is mechanically disrupted using a glass bead mill (Dynomill) using 0.5 mm nominal diameter beads, until 95% of the cells are broken. Concentrated sodium dodecylsulfate (SDS) is added to the lysate to yield a final concentration of SDS of ~2.14%. The lysate is then agitated and heated to 70° C.±5° C. for 10 minutes. The heated lysate is diluted with 3 volumes of buffer containing 67M Tris HCl, pH 7.0, 2.25% SDS, and is cooled to 20–25° C. Gross debris is removed from the diluted lysate by centrifugation using a Westphalia SA1 continuous flow desludging centrifuge at a feed rate of about 1.5 liters per minute and back pressure of 20–23 psig. The desludge interval is about 3.5 minutes.

One of the *E. coli* extracts used in the diluent is comprised of bacterial proteins which are solubilized during urea treatment of an insoluble protein fraction. This extract is prepared from a lysate of strain D1210 cells transformed with the expression vector pSODcf1 (see Section IV.B.1.). The cells are cultured and pelleted as described in Section IV.N.7.b., except that the pSODcf1 transformants replace the transformants which harbor pSODcf1 containing the HCV sequence from clone 5-1-1. In order to prepare the extract, 40 g of pelleted cells are placed into a 500 mL Beckman bottle, and resuspended in 14.4 mL of TE buffer (10 mM Tris, pH8.0, 1 mM EDTA). Next, 18 mL of distilled water, 6.8 mL of lysozyme solution, 0.8 mL of 0.1M PMSF (in ethanol) are added to the suspension, and it is incubated on ice for 1 hour. After the incubation, a solution containing 120 mL sterile water, 240 mL 0.5 M $MgCl_2$, 180 mL DNAse 1 (20,000 U/mL in distilled water) and 1.2 mL of 0.1 M PMSF is added for each 40 g of cells. The suspension is then sonicated in a Branson Sonifier 450 at setting 1 for 30 seconds and placed on ice for 1 minute; this cycle is repeated five more times, after which the sonicate is incubated at room temperature for 15 minutes. The solution is then sonicated at setting 5 for 30 seconds and placed on ice for 1 minute; this cycle is repeated 3 more times, after which the sonicate is incubated at room temperature for 15 minutes. This last cycle of sonication is repeated. After sonication, the sonicate is centrifuged at 10,000 rpm for 25 minutes. The supernatant is decanted, and the remaining pellet is extracted with urea as follows. Using an Omni mixer, the pellet is resuspended in 120 mL of 6 M urea, 50 mM Tris HCl, pH 8.0, 0.1% b-mercaptoethanol (BME). The bottle is attached to a tilt shaker and rocked at 4° C. for four hours. The suspension is then centrifuged at 10,000 rpm for 25 minutes at 4° C. The supernatant containing urea is dialyzed against a 400-fold volume of buffer containing 50 mM sodium borate, 0.5 M NaCl, pH 8.4. Dialysis is for 1.5 hours at room temperature, using Spectrapor® dialysis tubing with a molecular weight cut-off of 12,000–14,000. Precipitate in the dialysate is removed by centrifugation at 10,000 rpm for 15 minutes, and the supernatant is subjected to a repeated round of dialysis and centrifugation, yielding a supernatant which is used as the bacterial extract.

The second *E. coli* extract used in the diluent is prepared from non-transformed *E. coli* cells, and is comprised of proteins in the soluble fraction of the lysozyme treated bacteria. The extract is prepared by adding to 15 mL of packed cells the following: 3 mL of lysozyme (5 mg/mL) in 0.25 M Tris HCl, pH 8.0, 150 mL 0.1M PMSF in ethanol, 3.3 mL 0.25 M EDTA, pH 8.0, and 12.5 mL of a solution containing 1% Triton and 0.4% deoxycholate. The cells are suspended using an Omnimixer, and are broken by mixing for 15–25 minutes at 2–8° C.; if breakage is incomplete (i.e., the material is not viscous), an additional 150 mL 0.1 M PMSF is added, and the mixing is continued for an additional 15 to 25 minutes. After cell breakage, 20,000 units of DNAse I in 1 mL water and 15 mL 0.5 M $MgCl_2$ are added, and the mixing is continued for 15 to 25 minutes at room temperature, until the DNA is digested (i.e., the mixture approaches the viscosity of water. The mixture is then centrifuged at 17,000× G for 20 minutes at 2° C. to 8° C., and the supernatant is decanted. The supernatant is then dialyzed against 1 liter of phosphate buffered saline (PBS) from 8 to 72 hours, using Spectropor tubing with a molecular weight cutoff of 6,000 to 8,000. The protein concentration of the dialysate is adjusted to 5 to 15 mg/mL.

The immunoblot assay is performed by setting up one tube per sample, each containing a nitrocellulose assay strip. Each strip is banded with the three aforementioned HCV antigens, with hSOD, and with two levels of human IgG (internal controls), one of which yields a weak positive reaction, and one of which yields a moderate positive reaction. Sufficient working sample diluent is added to each tube to cover the strip with liquid. An aliquot of the appropriate specimen or control sample is added to each tube. The tubes are covered, and inverted to mix, the tubes are placed in a rocker, and agitated for 4 hours at room temperature. (The motion of the sample solution over the strips, generated by the rocker, is important in achieving even band staining and maximum sensitivity). After the 4 hour incubation, the tubes are uncapped, the liquid aspirated, and the strips are washed with distilled water, and transferred to a wash vessel. Following another three washes with excess distilled water, and removal of the wash by decantation, the strips are reacted with conjugate (the aliquot added is in excess of that which is sufficient to cover all of the strips). During the reaction with conjugate, the vessel containing the strip and conjugate is agitated on a rotary shaker at approximately 110 rpm for 30 minutes at room temperature. Excess conjugate is removed by washing the strips three times with an excess of distilled water, and the final wash is decanted. An aliquot of working substrate is added to the wash vessel, and the vessel is agitated on a rotary shaker at approximately 110 rpm for 15 minutes at room temperature. After the reaction, the working substrate is decanted off, and the strips are washed twice with excess distilled water. The strips are transferred to absorbent paper to blot off the excess water, air dried for at least twenty minutes at room temperature (protected from the light), and read within three hours after completion of the assay.

IV.N.1.b. Purification of SOD-NANB$_{5-1-1}$

The HCV fusion polypeptide, SOD-NANB$_{5-1-1}$ (also called the 5-1-1 polypeptide), used in the immunoblot assay system for HCV is purified according to the following procedure.

The 5-1-1 polypeptide is expressed in recombinant bacteria D1210 transformed with the vector described in Section IV.B.1. In order to prepare an overnight culture of the transformed bacteria, the cells (about 150 mL of glycerol stock) were grown in 35 mL of L broth containing 160±15 mL of 2% ampicillin); growth is overnight at 37° C. with shaking at 300 rpm. For expression, each 1.5 liters of culture (L broth containing 6.5±0.25 mL 2% ampicillin) is inoculated with 15 mL of the overnight culture, and grown at 37° C. in a Fembach flask with shaking for 2½ to 3 hours, until an OD$_{650}$ of 0.80±0.5 is attained; at this time expression is induced by the addition of 15 mL 200 mM IPTG. After induction, the cells are grown for 3 hours at 37° C. with shaking. The cells are then harvested by pelleting in a J6-B centrifuge in a JS5.2 rotor at 3.5K rpm for 15 minutes.

A 6 M urea extract of the cell pellet is prepared. Five grams of cell pellet is resuspended in 1.8 mL of TE, and then 2.25 mL sterile water, 0.85 mL lysozyme solution (5 mg/mL in 0.25 M Tris HCl, pH 8.0), and 100 mL of 0.1M PMSF in ethanol are added. The resuspended pellet is incubated on ice for one hour. After the incubation, 15 mL of distilled water, 30 mL of 0.5 M MgCl$_2$, 22.5 mL DNAse I (20,000 units/mL in water), and 150 mL of PMSF are added. The mixture is sonicated and the insoluble material pelleted using the procedure for the preparation of the E. coli extract described supra, except that sonication at setting 1 is repeated for a total of four times, and sonication at setting 5 is repeated for a total of two times. The pellet, which has a volume of about 1.5 mL is suspended in 15 mL of solution containing 6 M urea, 50 mM Tris HCl, pH 8.0, and 0.1% BME, using a pipetter and with vortexing. The suspension is then rocked in a tilt shaker at 4° C. for 4 hours, and centrifuged at 12,000 rpm for 15 minutes at 4° C.

The 5-1-1 polypeptide contained in the supernatant from the above described centrifugation is purified from the urea extract by passage through a Q Sepharose® Fast Flow ion exchange column (Pharmacia Corp.). A 30 mL column is equilibrated by pumping through approximately 80 mL of running buffer (6 M urea in 20 mM Tris HCl, pH 8.0, 1 mM dithiothreitol (DTT)), or RB, at a speed of about 2 mL per minute. After the column is equilibrated, the entire 6 M urea extract is loaded onto the column, and is washed in with approximately 80 mL of running buffer; fractions of 2 mL are collected during the loading and the washing steps. After the load is washed into the column, the 5-1-1 polypeptide is eluted using a 0.0 to 0.5 M NaCl gradient in RB. The gradient solution is pumped over the column at 2 mL per minute; 1 mL fractions are collected; and the OD$_{280}$ is monitored throughout the load, wash, and elution. The 5-1-1 polypeptide is expected to elute from the column approximately two-thirds of the way through the gradient. The column fractions are analyzed by electrophoresis on 12.5% polyacrylamide gels containing SDS, and by Western blot using positive polyclonal antibodies to SOD and/or the 5-1-1 polypeptide and/or serum samples. The purity of the 5-1-1 polypeptide is estimated based upon the O.D.$_{280}$, the Western blot, and the polyacrylamide gel analysis. Based upon this, appropriate fractions are pooled, yielding a total volume of ~30 mL. Each 10 mL of the pooled material is dialyzed at room temperature against 2 liters of buffer containing 50 mM sodium borate, pH 8.4, 0.5 M NaCl, 10 mM BME, and 2 mM EDTA for 1.5 hours, with 1 change of buffer after 1.5 hours; total dialysis time is approximately 3 hours. Protein concentration in the dialysate is determined by the Lowry method. The purified, dialyzed material is stored at −70° C.

IV.O Preparation of HCV Vaccines

IV.O.1 Preparation of Hybrid Particle Immunogens

The immunogenicity of the epitopes of HCV may also be enhanced by preparing them in mammalian or yeast systems fused with or assembled with particle-forming proteins such as, for example, that associated with hepatitis B surface antigen. See, e.g., U.S. Pat. No. 4,722,840, incorporated herein by reference. Constructs wherein the NANBV epitope is linked directly to the particle-forming protein coding sequences produce hybrids which are immunogenic with respect to the HCV epitope. In addition, all of the vectors prepared include epitopes specific to HBV, having various degrees of immunogenicity, such as, for example, the pre-S peptide. Thus, particles constructed from particle forming protein which include HCV sequences are immunogenic with respect to HCV and HBV.

Hepatitis surface antigen (HBsAg) has been shown to be formed and assembled into particles in *S. cerevisiae* (P. Valenzuela et al., *Nature* (1982) 298:344), as well as in, for example, mammalian cells (P. Valenzuela et al. in "Hepatitis B" (I. Millman et al., ed, Plenum Press, 1984) pp. 225–236). The formation of such particles has been shown to enhance the immunogenicity of the monomer subunit. The constructs may also include the immunodominant epitope of HBsAg, comprising the 55 amino acids of the presurface (pre-S) region (Neurath et al, *Science* (1984) 224:392). Constructs of the pre-S-HBsAg particle expressible in yeast are disclosed in EPO 174,444, published Mar. 19, 1986; hybrids including heterologous viral sequences for yeast expression are disclosed in EPO 175,261, published Mar. 26, 1966. These constructs may also be expressed in mammalian cells such as Chinese hamster ovary (CHO) cells using an SV40-dihydrofolate reductase vector (Michelle et al., *Int Symposium on Viral Hepatitis* (1984)).

In addition, portions of the particle-forming protein coding sequence may be replaced with codons encoding an HCV epitope. In this replacement, regions which are not required to mediate the aggregation of the units to form immunogenic particles in yeast or mammals can be deleted, thus eliminating additional HBV antigenic sites from competition with the HCV epitope.

IV.O.2 Preparation of Vaccines

Vaccines may be prepared from one or more immunogenic polypeptides derived from HCV. The observed homology between HCV and Flaviviruses provides information concerning the polypeptides which are likely to be most effective as vaccines, as well as the regions of the genome in which they are encoded. The general structure of the Flavivirus genome is discussed in Rice et al., in "The Viruses" supra p.279–328. The flavivirus genomic RNA is believed to be the only virus-specific mRNA species, and is translated into the three viral structural proteins (C, M, and E) as well as two large nonstructural proteins, NS4 and NS5, and a complex set of smaller nonstructural proteins. It is known that major neutralizing epitopes for Flaviviruses reside in the E (envelope) protein (Roehrig in "The Viruses" supra). The corresponding HCV E gene and polypeptide encoding region may be predicted, based upon the homology to Flaviviruses. Thus, vaccines may comprise recombinant polypeptides containing epitopes of HCV E. These polypeptides may be expressed in various host cells (e.g., bacteria, yeast, insect, or mammalian cells), or alternatively may be isolated from viral preparations. It is also anticipated that the other structural proteins may also contain epitopes which give rise to protective anti-HCV antibodies. Thus, polypeptides containing the epitopes of E, C, and M may also be used, whether singly or in combination, in HCV vaccines.

In addition to the above, it has been shown that immunization with NS1 (nonstructural protein 1), results in protection against yellow fever (Schlesinger et al, *J Virol* (1986) 60:1153). This is true even though the immunization does not give rise to neutralizing antibodies. Thus, particularly since this protein appears to be highly conserved among Flaviviruses, it is likely that HCV NS1 will also be protective against HCV infection. Moreover, it also shows that nonstructural proteins may provide protection against viral pathogenicity, even if they do not cause the production of neutralizing antibodies.

In view of the above, multivalent vaccines against HCV may comprise one or more epitopes from one or more structural proteins, and/or one or more epitopes from one or more nonstructural proteins. These vaccines may comprise, for example, recombinant HCV polypeptides and/or polypeptides isolated from the virions. In particular, vaccines are contemplated comprising one or more of the following HCV proteins, or subunit antigens derived therefrom: E, NS1, C, NS2, NS3, NS4 and NS5. Particularly preferred are vaccines comprising E and/or NS 1, or subunits thereof. In addition, it may be possible to use inactivated HCV in vaccines; inactivation may be by the preparation of viral lysates, or by other means known in the art to cause inactivation of Flaviviruses, for example, treatment with organic solvents or detergents, or treatment with formalin. Moreover, vaccines may also be prepared from attenuated HCV strains.

It is known that some of the proteins in Flaviviruses contain highly conserved regions. Thus, some immunological cross-reactivity is possible between HCV and other Flaviviruses. It is possible that shared epitopes between the Flaviviruses and HCV will give rise to protective antibodies against one or more of the disorders caused by these pathogenic agents. Thus, it may be possible to design multipurpose vaccines based upon this knowledge.

In addition to the above, it is also possible to prepare live vaccines of attenuated microorganisms which express one or more recombinant HCV polypeptides. Suitable attenuated microorganisms are known in the art and include, without limitation, viruses and bacteria. See for example Dulbecco, U.S. Pat. No. 4,593,002, incorporated herein by reference.

The preparation of vaccines which contain an immunogenic polypeptide(s) as active ingredients, is known to one skilled in the art. Typically, such vaccines are prepared as injectables, either as liquid solutions or suspensions; solid forms suitable for solution in, or suspension in, liquid prior to injection may also be prepared. The preparation may also be emulsified, or the protein encapsulated in liposomes. The active immunogenic ingredients are often mixed with excipients which are pharmaceutically acceptable and compatible with the active ingredient. Suitable excipients are, for example, water, saline, dextrose, glycerol, ethanol, or the like and combinations thereof. In addition, if desired, the vaccine may contain minor amounts of auxiliary substances such as wetting or emulsifying agents, pH buffering agents, and/or adjuvants which enhance the effectiveness of the vaccine. Examples of adjuvants which may be effective include but are not limited to: aluminum hydroxide, N-acetyl-muramyl-L-threonyl-D-isoglutamine (thr-MDP), N-acetyl-nor-muramyl-L-alanyl-D-isoglutamine (CGPL 1637, referred to as nor-MDP), N-acetylmuramyl-L-alanyl-D-isoglutaminyl-L-alanine-2-(1'-2'-dipalmitoyl-sn-glycero-3-hydroxyphosphoryloxy)-ethylamine (CGP 19835A, referred to as MTP-PE), and RIBI, which contains three components extracted from bacteria, monophosphoryl lipid A, trehalose dimycolate and cell wall skeleton (MPL+TDM+CWS) in a 2% squalene/Tween® 80 emulsion. The effectiveness of an adjuvant may be determined by measuring the amount of antibodies directed against an immunogenic polypeptide containing an HCV antigenic sequence resulting from administration of this polypeptide in vaccines which also comprise the various adjuvants.

The vaccines are conventionally administered parenterally, by injection; for example, either subcutaneously or intramuscularly. Additional formulations which are suitable for other modes of administration include suppositories and, in some cases, oral formulations. For suppositories, traditional binders and carriers may include, for example, polyalkylene glycols or triglycerides; such suppositories may be formed from mixtures containing the active ingredient in the range of 0.5% to 10%, preferably 1%–2%. Oral formulations include such normally employed excipients as, for example, pharmaceutical grades of mannitol, lactose, starch, magnesium stearate, sodium saccharine, cellulose, magnesium carbonate, and the like. These compositions take the form of solutions, suspensions, tablets, pills, capsules, sustained release formulations or powders and contain 10%–95% of active ingredient, preferably 25%–70%.

The proteins may be formulated into the vaccine as neutral or salt forms. Pharmaceutically acceptable salts include the acid addition salts (formed with free amino groups of the peptide) and which are formed with inorganic acids such as, for example, hydrochloric or phosphoric acids, or such organic acids such as acetic, oxalic, tartaric, maleic, and the like. Salts formed with the free carboxyl groups may also be derived from inorganic bases such as, for example, sodium, potassium, ammonium, calcium, or ferric hydroxides, and such organic bases as isopropylamine, trimethylamine, 2-ethylaminoethanol, histidine, procaine, and the like.

Vaccines are administered in a manner compatible with the dosage formulation, and in such amount as will be prophylactically and/or therapeutically effective. The quantity to be administered, which is generally in the range of 5 mg to 250 mg of antigen per dose, depends on the subject to be treated, capacity of the subject's immune system to express antibodies, and the degree of protection desired. Precise amounts of active ingredient required to be administered may depend on the judgment of the practitioner and may be peculiar to each subject.

The vaccine may be given in a single dose schedule, or preferably in a multiple dose schedule. A multiple dose schedule is one in which a primary course of vaccination may be with 1–10 separate doses, followed by other doses given at subsequent time intervals required to maintain and or reinforce the immune response, for example, at 1–4 months for a second dose, and if needed, a subsequent dose(s) after several months. The dosage regimen will also, at least in part, be determined by the need of the individual and be dependent upon the judgment of the practitioner.

In addition, the vaccine containing the immunogenic HCV antigen(s) may be administered in conjunction with other immunoregulatory agents, for example, immune globulins.

V. Deposit Information

The following listed materials are on deposit under the terms of the Budapest Treaty with the American Type Culture Collection (ATCC), 12301 Parklawn Dr., Rockville, Md. 20852, and have been assigned the following Accession Numbers.

| λgt11 | ATCC No. | Deposit Date |
| --- | --- | --- |
| HCV cDNA library | 40394 | 1 Dec. 1987 |
| clone 81 | 40388 | 17 Nov. 1987 |
| clone 91 | 40389 | 17 Nov. 1987 |
| clone 1-2 | 40390 | 17 Nov. 1987 |
| clone 5-1-1 | 40391 | 18 Nov. 1987 |
| clone 12f | 40514 | 10 Nov. 1988 |
| clone 35f | 40511 | 10 Nov. 1988 |
| clone 15e | 40513 | 10 Nov. 1988 |
| clone K9-1 | 40512 | 10 Nov. 1988 |
| JSC 308 | 20879 | 5 May 1988 |
| pS356 | 67683 | 29 April 1988 |

In addition, the following deposits were made on May 11, 1989.

| Strain | Linkers | ATCC No. |
| --- | --- | --- |
| D1210 (Cf1/5-1-1) | EF | 67967 |
| D1210 (Cf1/81) | EF | 67968 |
| D1210 (Cf1/CA74a) | EF | 67969 |
| D1210 (Cf1/35f) | AB | 67970 |
| D1210 (Cf1/279a) | EF | 67971 |
| D1210 (Cf1/C36) | CD | 67972 |
| D1210 (Cf1/13i) | AB | 67973 |
| D1210 (Cf1/C33b) | EF | 67974 |
| D1210 (Cf1/CA290a) | AB | 67975 |
| HB101 (AB24/C100 #3R) | | 67976 |

The following derivatives of strain D1210 were deposited on May 3, 1989.

| Strain Derivative | ATCC No. |
| --- | --- |
| pCF1CS/C8f | 67956 |
| pCF1AB/C12f | 67952 |

-continued

| Strain Derivative | ATCC No. |
| --- | --- |
| pCF1EF/14c | 67949 |
| pCF1EF/15e | 67954 |
| pCF1AB/C25c | 67958 |
| pCF1EF/C33c | 67953 |
| pCF1EF/C33f | 67050 |
| pCF1CD/33g | 67951 |
| pCF1CD/C39c | 67955 |
| pCF1EF/C40b | 67957 |
| pCF1EF/CA167b | 67959 |

The following biological materials were deposited on May 12, 1989.

| Material | ATCC No. |
| --- | --- |
| λgt11(C35) | 40603 |
| λgt10(b-5a) | 40602 |
| D1210(C40b) | 67980 |
| D1210(M16) | 67981 |

The following biological materials were deposited on Oct. 13, 1989.

| Material | ATCC No. |
| --- | --- |
| AB122 | 20961 |
| λgt11 | 40678 |
| pAB24/C200-C100 | 40679 |
| pNS11d- 13-15 | 40680 |
| pC100-d #3 | 68113 |
| pC22 | 68114 |
| pS2d #9 | 68115 |

The following biological materials were deposited on Oct. 17, 1989.

| Material | ATCC No. |
| --- | --- |
| pCMV-NS1 | 68125 |
| pMCMV-NS1 | 68126 |

Upon allowance and issuance of this application as a United States Patent, all restriction on availability of these deposits will be irrevocably removed; and access to the designated deposits will be available during pendency of the above-named application to one determined by the Commissioner to be entitled thereto under 37 CFR 1.14 and 35 USC 1.22. Moreover, the designated deposits will be maintained for a period of thirty (30) years from the date of deposit, or for five (5) years after the last request for the deposit; or for the enforceable life of the U.S. patent, whichever is longer. The deposited materials mentioned herein are intended for convenience only, and are not required to practice the present invention in view of the descriptions herein, and in addition these materials are incorporated herein by reference.

VI. Industrial Applicability

The invention, in the various manifestations disclosed herein, has many industrial uses, some of which are the following. The HCV cDNAs may be used for the design of probes for the detection of HCV nucleic acids in samples. The probes derived from the cDNAs may be used to detect HCV nucleic acids in, for example, chemical synthetic reactions. They may also be used in screening programs for anti-viral agents, to determine the effect of the agents in inhibiting viral replication in cell culture systems, and animal model systems. The HCV polynucleotide probes are also useful in detecting viral nucleic acids in humans, and thus, may serve as a basis for diagnosis of HCV infections in humans.

In addition to the above, the cDNAs provided herein provide information and a means for synthesizing polypeptides containing epitopes of HCV. These polypeptides are useful in detecting antibodies to HCV antigens. A series of immunoassays for HCV infection, based on recombinant polypeptides containing HCV epitopes are described herein, and will find commercial use in diagnosing HCV induced NANBH, in screening blood bank donors for HCV-caused infectious hepatitis, and also for detecting contaminated blood from infectious blood donors. The viral antigens will also have utility in monitoring the efficacy of anti-viral agents in animal model systems. In addition, the polypeptides derived from the HCV cDNAs disclosed herein will have utility as vaccines for treatment of HCV infections.

The polypeptides derived from the HCV cDNAs, besides the above stated uses, are also useful for raising anti-HCV antibodies. Thus, they may be used in anti-HCV vaccines. However, the antibodies produced as a result of immunization with the HCV polypeptides are also useful in detecting the presence of viral antigens in samples. Thus, they may be used to assay the production of HCV polypeptides in chemical systems. The anti-HCV antibodies may also be used to monitor the efficacy of anti-viral agents in screening programs where these agents are tested in tissue culture systems. They may also be used for passive immunotherapy, and to diagnose HCV caused NANBH by allowing the detection of viral antigen(s) in both blood donors and recipients. Another important use for anti-HCV antibodies is in affinity chromatography for the purification of virus and viral polypeptides. The purified virus and viral polypeptide preparations may be used in vaccines. However, the purified virus may also be useful for the development of cell culture systems in which HCV replicates.

Cell culture systems containing HCV infected cells will have many uses. They can be used for the relatively large scale production of HCV, which is normally a low titer virus. These systems will also be useful for an elucidation of the molecular biology of the virus, and lead to the development of anti-viral agents. The cell culture systems will also be useful in screening for the efficacy of antiviral agents. In addition, HCV permissive cell culture systems are useful for the production of attenuated strains of HCV.

For convenience, the anti-HCV antibodies and HCV polypeptides, whether natural or recombinant, may be packaged into kits.

The method used for isolating HCV cDNA, which is comprised of preparing a cDNA library derived from infected tissue of an individual, in an expression vector, and selecting clones which produce the expression products which react immunologically with antibodies in antibody-containing body components from other infected individuals and not from non-infected individuals, may also be applicable to the isolation of cDNAs derived from other heretofore uncharacterized disease-associated agents which are comprised of a genomic component. This, in turn, could lead to isolation and characterization of these agents, and to diagnostic reagents and vaccines for these other disease-associated agents.

SEQUENCE LISTING (777 sequences)

SEQ ID NO: 1 - DNA (cDNA), 155 bp; single-stranded, linear
  CDS 2..154
  immediate source clone: 5-1-1
ggcctcctgcttgaactgctcggcgagcatcatacctgacagggaagtcctctaccgagagttcgatgagatggaagagtgctctcagcacttaccgtacatcgagcaagggatgatgctcgccgagcagttcaagcagaaggccctcggcctcc

SEQ ID NO: 2 - protein, 51 aa
ASCLNCSASIIPDREVLYREFDEMEECSQHLPYIEQGMMLAEQFKQKALGL

SEQ ID NO: 3 - DNA (cDNA), 155 bp; single-stranded, linear; identical to SEQ ID NO: 1
  immediate source clone: 5-1-1

SEQ ID NO: 4 - DNA (cDNA), 353 bp; single-stranded, linear
  immediate source clone: 81
gtccgggaagccggcaatcatacctgacagggaagtcctctaccgagagttcgatgagatggaagagtgctctcagcacttaccgtacatcgagcaagggatgatgctcgccgagcagttcaagcagaaggccctcggcctcctgcagaccgcgtcccgtcaggcagaggttatcgcccctgctgtccagaccaactggcaaaaactcgagaccttctgggcgaagcatatgtggaacttcatcagtgggatacaatacttggcgggcttgtcaacgctgcctggtaaccccgccattgcttcattgatggcttttacagctgctgtcaccagcccactaaccactagccaaa

SEQ ID NO: 5 - DNA (cDNA), 318 bp; single-stranded, linear
  immediate source clone: 91
ctggctgcgtggtcatagtgggcagggtcgtcttgtccgggaagccggcaatcatacctgacagggaagtcctctacgagagttcgatgagatggaagagtgctctcagcacttaccgtacatcgagcaagggatgatgctcgccgagcagttcaagcagaaggccctcggcctcctgcagaccgcgtcccgtcaggcagaggttatcgcccctgctgtccagaccaactggcaaaaactcgagaccttctgggcgaagcatatgtggaacttcatcagtgggatacaatacttggcgggcttgtcaacgctgcctgg

SEQ ID NO: 6 - DNA (cDNA), 164 bp; single-stranded, linear
  immediate source clone: 1-2
ggtcatagtgggcagggtcgtcttgtccgggaagccggcaatcatacctgacagggaagtcctctatcgagagttcgatgagatggaagagtgctctcagcacttaccgtacatcgagcaagggatgatgctcgccgagcagttcaagcagaaggccctcggcc

SEQ ID NO: 7 - DNA (cDNA), 387 bp; single-stranded, linear
  CDS 3..386
  misc_feature 77: /note= "A heterogeneity may exist nucleotide 77 = C or T and amino acid Xaa = Tyr"
ctggctgcgtggtcatagtgggcagggtcgtcttgtccgggaagccggcaatcatacctgacagggaagtcctctaycgagagttcgatgagatggaagagtgctctcagcacttaccgtacatcgagcaagggatgatgctcgccgagcagttcaagcagaaggccctcggcctcctgcagaccgcgtcccgtcaggcagaggttatcgcccctgctgtccagaccaactggcaaaaactcgagaccttctgggcgaagcatatgtggaacttcatcagtgggatacaatacttggcgggcttgtcaacgctgcctggtaaccccgccattgcttcattgatggcttttacagctgctgtcaccagcccactaaccactagccaaa

SEQ ID NO: 8 - protein, 128 aa
GCVVIVGRVVLSGKPAIIPDREVLXREFDEMEECSQHLPYIEQGMMLAEQFKQKALGLLQTASRQAEVIAPAVQTNWQKLETFWAKHMWNFISGIQYLAGLSTLPGNPAIASLMAFTAAVTSPLTTSQ

SEQ ID NO: 9 - DNA (cDNA), 353 bp; single-stranded, linear; identical to SEQ ID NO: 4
  CDS 2..352

SEQ ID NO: 10 - protein, 117 aa
SGKPAIIPDREVLYREFDEMEECSQHLPYIEQGMMLAEQFKQKALGLLQTASRQAEVIAPAVQTNWQKLETFWAKHMWNFISGIQYLAGLSTLPGNPAIASLMAFTAAVTSPLTTSQ

SEQ ID NO: 11 - DNA (cDNA), 406 bp; single-stranded, linear
  CDS 1..405
gatgcccactttgtatcccagacaaagcagagtggggagaaccttccttacctggtagcgtaccaagccaccgtgtgcgctagggctcaagcccctcccccatcgtgggaccagatgtggaagtgtttgattcgcctcaagcccaccctccatgggccaacacccctgctatacagactgggcgctgttcagaatgaaatcaccctgacgcacccagtcaccaaatacatcatgacatgcatgtcggccgacctggaggtcgtcacgagcacctgggtgctcgttggcggcgtcctggctgctttggccgcgtattgcctgtcaacaggctgcgtggtcatagtgggcagggtcgtcttgtccgggaagccggcaatcatacctgacagggaagtcctctaccgag

SEQ ID NO: 12 - protein, 135 aa
DAHFVSQTKQSGENLPYLVAYQATVCARAQAPPPSWDQMWKCLIRLKPTLHGPTPLLYRLGAVQNEITLTHPVTKYIMTCMSADLEVVTSTWVLVGGVLAALAAYCLSTGCVVIVGRVVLSGKPAIIPDREVLYR

SEQ ID NO: 13 - DNA (cDNA), 712 bp; single-stranded, linear
  CDS 1..711
gatgcccactttctatcccagacaaagcagagtggggagaaccttccttacctggtagcgtaccaagccaccgtgtgcgctagggctcaagcccctcccccatcgtgggaccagatgtggaagtgtttgattcgcctcaagcccaccctccatgggccaacacccctgctatacagactgggcgctgttcagaatgaaatcaccctgacgcacccagtcaccaaatacatcatgacatgcatgtcggccgacctggaggtcgtcacgagcacctgggtgctcgttggcggcgtcctggctgctttggccgcgtattgcctgtcaacaggctgcgtggtcatagtgggcagggtcgtcttgtccgggaagccggcaatcatacctgacagggaagtcctctaccgagagttcgatgagatggaagagtgctctcagcacttaccgtacatcgagcaagggatgatgctcgccgagcagttcaagcagaaggccctcggcctcctgcagaccgcgtcccgtcaggcagaggttatcggccctgctgtccagaccaactggcaaaaactcgagaccttctgggcgaagcatatgtggaacttcatcagtgggatacaatacttggcgggcttgtcaacgctgcctggtaaccccgccattgcttcattgatggcttttacagctgctgtcaccagcccactaaccactagccaaa

SEQ ID NO: 14 - protein, 237 aa
DAHFLSQTKQSGENLPYLVAYQATVCARAQAPPPSWDQMWKCLIRLKPTLHGPTPLLYRLGAVQNEITLTHPVTKYIMTCMSADLEVVTSTWVLVGGVLAALAAYCLSTGCVVIVGRVVLSGKPAIIPDREVLYREFDEMEECSQHLPYIEQGMMLAEQFKQKALGLLQTASRQAEVIGPAVQTNWQKLETFWAKHMWNFISGIQYLAGLSTLPGNPAIASLMAFTAAVTSPLTTSQ

SEQ ID NO: 15 - DNA (cDNA), 418 bp; single-stranded, linear
  CDS 3..416
cttttacagctgctgtcaccagcccactaaccactagccaaaccctcctcttcaacatattgggggggtgggtggctgcccagctcgccgcccccggtgccgctactgcctttgtgggcgctggcttagctggcgccgccatcggcagtgttggactggggaaggtcctcatagacatccttgcagggtatggcgcgggcgtggcgggagctcttgtggcattcaagatcatgagcggtgaggtcccctccacggaggacctggtcaatctactgcccgccatcctctcgcccggagccctcgtagtcggcgtggtctgtgcagcaatactgcgccggcacgttggcccgggcgagggggcagtgcagtggatgaaccggctgatagccttcgcctcccgggggaaccatgtttcccc

SEQ ID NO: 16 - protein, 138 aa
FTAAVTSPLTTSQTLLFNILGGWVAAQLAAPGAATAFVGAGLAGAAIGSVGLGKVLIDILAGYGAGVAGALVAFKIMSGEVPSTEDLVNLLPAILSPGALVVGVVCAAILRRHVGPGEGAVQWMNRLIAFASRGNHVS

SEQ ID NO: 17 - DNA (cDNA), 480 bp; single-stranded, linear
  CDS 1..480
tccattgagacaatcacgctcccccaggatgctgtctcccgcactcaacgtcggggcaggactggcagggggaagccaggcatctacagatttgtggcaccgggggagcgcccctccggcatgttcgactcgtccgtcctctgtgagtgctatgacgcaggctgtgcttggtatgagctcacgcccgccgagactacagttaggctacgagcgtacatgaacaccgcggggcttcccgtgtgccaggaccatcttgaattttgggagggcgtctttacaggcctcactcatatagatgcccactttctatcccagacaaagcagagtggggagaaccttccttacctggtagcgtaccaagccaccgtgtgcgctagggctcaagcccctcccccatcgtgggaccagatgtggaagtgtttgattcgcctcaagcccaccctccatgggccaacacccctgctatacagactgggcgct

SEQ ID NO: 18 - protein, 160 aa
SIETITLPQDAVSRTQRRGRTGRGKPGIYRFVAPGERPSGMFDSSVLCECYDAGCAWYELTPAETTVRLRAYMNTAGLPVCQDHLEFWEGVFTGLTHIDAHFLSQTKQSGENLPYLVAYQATVCARAQAPPPSWDQMWKCLIRLKPTLHGPTPLLYRLGA

SEQ ID NO: 19 - DNA (cDNA), 1382 bp; single-stranded, linear
  CDS 1..1380
tccattgagacaatcacgctcccccaggatgctgtctcccgcactcaacgtcggggcaggactggcagggggaagccaggcatctacagatttgtggcaccgggggagcgcccctccggcatgttcgactcgtccgtcctctgtgagtgctatgacgcaggctgtgcttggtatgagctcacgcccgccgagactacagttaggctacgagcgtacatgaacaccccggggcttcccgtgtgccaggaccatcttgaattttgggagcgcgtctttacaggcctcactcatatagatgcccactttctatcccagacaaagcagagtggggagaaccttccttacctggtagcgtaccaagccaccgtgtgcgctagggctcaagcccctcccccatcgtgggaccagatgtggaagtgtttgattcgcctcaagcccaccctccatgggccaacacccctgctatacagactgggcgctgttcagaatgaaatcaccctgacgcacccagtcaccaaatacatcatgacatgcatgtcggccgacctggaggtcgtcacgagcacctgggtgctcgttggcggcgtcctggctgctttggccgcgtattgcctgtcaacaggctgcgtggtcatagtgggcagggtcgtcttgtccgggaagccggcaatcatacctgacagggaagtcctctaccgagagttcgatgagatggaagagtgctctcagcacttaccgtacatcgagcaagggatgatgctcgccgagcagttcaagcagaaggccctcggcctcctgcagaccgcgtcccgtcaggcagaggttatcgcccctgctgtccagaccaactggcaaaaactcgagaccttctgggcgaagcatatgtggaacttcatcagtgggatacaatacttggcgggcttgtcaacgctgcctggtaaccccgccattgcttcattgatggcttttacagctgctgtcaccagcccactaaccactagccaaaccctcctcttcaacatattgggggggtgggtggctgcccagctcgccgcccccggtgccgctactgcctttgtgggcgctggcttagctggcgccgccatcggcagtgttggactggggaaggtcctcatagacatccttgcagggtatggcgcgggcgtggcgggagctcttgtggcattcaagatcatgagcggtgaggtcccctccacggaggacctggtcaatctactgcccgccatcctctcgcccggagccctcgtagtcggcgtggtctgtgcagcaatactgcgccggcacgttggcccgggcgagggggcagtgcagtggatgaaccggctgatagccttcgcctcccgggggaaccatgtttcccc

SEQ ID NO: 20 - protein, 460 aa
SIETITLPQDAVSRTQRRGRTGRGKPGIYRFVAPGERPSGMFDSSVLCECYDAGCAWYELTPAETTVRLRAYMNTPGLPVCQDHLEFWERVFTGLTHIDAHFLSQTKQSGENLPYLVAYQATVCARAQAPPPSWDQMWKCLIRLKPTLHGPTPLLYRLGAVQNEITLTHPVTKYIMTCMSADLEVVTSTWVLVGGVLAALAAYCLSTGCVVIVGRVVLSGKPAIIPDREVLYREFDEMEECSQHLPYIEQGMMLAEQFKQKALGLLQTASRQAEVIAPAVQTNWQKLETFWAKHMWNFISGIQYLAGLSTLPGNPAIASLMAFTAAVTSPLTTSQTLLFNILGGWVAAQLAAPGAATAFVGAGLAGAAIGSVGLGKVLIDILAGYGAGVAGALVAFKIMSGEVPSTEDLVNLLPAILSPGALVVGVVCAAILRRHVGPGEGAVQWMNRLIAFASRGNHVS

SEQ ID NO: 21 - DNA (cDNA), 268 bp; single-stranded, linear
  CDS 1..267
ctcgccgcaaagctggtcgcattgggcatcaatgccgtggcctactaccgcggtcttgacgtgtccgtcatcccgaccagcggcgatgttgtcgtcgtggcaaccgatgccctcatgaccggctataccggcgacttcgactcggtgatagactacaatacgtgtgtcacccagacagtcgatttcagccttgaccctaccttcaccattgagacaatcacgctcccccaggatgctgtctcccgcactcaacgtcggggcaggactg

SEQ ID NO: 22 - protein, 89 aa
LAAKLVALGINAVAYYRGLDVSVIPTSGDVVVVATDALMTGYTGDFDSVIDYNTCVTQTVDFSLDPTFTIETITLPQDAVSRTQRRGRT

SEQ ID NO: 23 - DNA (cDNA), 319 bp; single-stranded, linear
  CDS 2..319
gatgaaccggctgatagccttcgcctcccgggggaaccatgtttcccccacgcactacgtgccggagagcgatgcagctgcccgcgtcactgccatactcagcagcctcactgtaacccagctcctgaggcgactgcaccagtggataagctcggagtgtaccactccatgctccggttcctggctaagggacatctgggactggatatgcgaggtgttgagcgactttaagacctggctaaaagctaagctcatgccacagctgcctgggatcccctttgtgtcctgccagcgcgggtataagggggtctggcgagtg

SEQ ID NO: 24 - protein, 106 aa
MNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYKGVWRV

SEQ ID NO: 25 - DNA (cDNA), 492 bp; single-stranded, linear
  CDS 2..490
ggcttacatgtccaaggctcatgggatcgatcctaacatcaggaccggggtgagaacaattaccactggcagccccatcacgtactccacctacggcaagttccttgccgacggcgggtgctcggggggcgcttatgacataataatttgtgacgagtgccactccacggatgccacatccatcttgggcatcggcactgtccttgaccaagcagagactgcgggggcgagactggttgtgctcgccaccgccacccctccgggctccgtcactgtgccccatcccaacatcgaggaggttgctctgtccaccaccggagagatccctttttacggcaaggctatccccctcgaagtaatcaagggggggagacatctcatcttctgtcattcaaagaagaagtgcgacgaactcgccgcaaagctggtcgcattgggcatcaatgccgtggcctactaccgcggtcttgacgtgtccgtcatcccgaccag

SEQ ID NO: 26 - protein, 163 aa
AYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPT

SEQ ID NO: 27 - DNA (cDNA), 531 bp; single-stranded, linear
  CDS 3..530
actgcagcctcactgtaacccagctcctgaggcgactgcaccagtggataagctcggagtgtaccactccatgctccggttcctggctaagggacatctgggactggatatgcgaggtgttgagcgactttaagacctggctaaaagctaagctcatgccacagctgcctgggatcccctttgtgtcctgccagcgcgggtataagggggtctggcgaggggacggcatcatgcacactcgctgccactgtggagctgagatcactggacatgtcaaaaacgggacgatgaggatcgtcggtcctaggacctgcaggaacatgtggagtgggaccttccccattaatgcctacaccacgggcccctgtaccccccttcctgcgccgaactacacgttcgcgctatggagggtgtctgcagaggaatatgtggagataaggcaggtgggggacttccactacgtgacgggtatgactactgacaatctcaaatgcccgtgccaggtcccatcgcccgaatttttcacagaat

SEQ ID NO: 28 - protein, 176 aa
CSLTVTQLLRRLHQWISSECTTPCSGSWLRDIWDWICEVLSDFKTWLKAKLMPQLPGIPFVSCQRGYKGVWRGDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTE

SEQ ID NO: 29 - DNA (cDNA), 2579 bp; single-stranded, linear
  CDS 2..2578
tgcttacatgtccaaggctcatgggatcgatcctaacatcaggaccggggtgagaacaattaccactggcagccccatcacgtactccacctacggcaagttccttgccgacggcgggtgctcggggggcgcttatgacataataatttgtgacgagtgccactccacggatgccacatccatcttgggcatcggcactgtccttgaccaagcagagactgcgggggcgagactggttgtgctcgccaccgccacccctccgggctccgtcactgtgccccatcccaacatcgaggaggttgctctgtccaccaccggagagatccctttttacggcaaggctatccccctcgaagtaatcaagggggggagacatctcatcttctgtcattcaaagaagaagtgcgacgaactcgccgcaaagctggtcgcattgggcatcaatgccgtggcctactaccgcggtcttgacgtgtccgtcatcccgaccagcggcgatgttgtcgtcgtggcaaccgatgccctcatgaccggctataccggcgacttcgactcggtgatagactacaatacgtgtgtcacccagacagtcgatttcagccttgaccctaccttcaccattgagacaatcacgctcccccaggatgctgtctcccgcactcaacgtcggggcaggactggcagggggaagccaggcatctacagatttgtggcaccggggcagcgcccctccggcatgttcgactcgtccgtcctctgtgagtgctatgacgcaggctgtgcttggtatgagctcacgcccgccgagactacagttaggctacgagcgtacatgaacaccccggggcttcccgtgtgccaggaccatcttgaattttgggagggcgtctttacaggcctcactcatatagatgcccactttctatcccagacaaagcagagtggggagaaccttccttacctggtagcgtaccaagccaccgtgtgcgctagggctcaagcccctcccccatcgtgggaccagatgtggaagtgtttgattcgcctcaagcccaccctccatgggccaacacccctgctatacagactgggcgctgttcagaatgaaatcaccctgacgcacccagtcaccaaatacatcatgacatgcatgtcggccgacctggaggtcgtcacgagcacctgggtgctcgttggcggcgtcctggctgctttggccgcgtattgcctgtcaacaggctgcgtggtcatagtgggcagggtcgtcttgtccgggaagccggcaatcatacctgacagggaagtcctctaccgagagttcgatgagatggaagagtgctctcagcacttaccgtacatcgagcaagggatgatgctcgccgagcagttcaagcagaaggccctcggcctcctgcagaccgcgtcccgtcaggcagaggttatcgcccctgctgtccagaccaactggcaaaaactcgagaccttctgggcgaagcatatgtggaacttcatcagtgggatacaatacttggcgggcttgtcaacgctgcctggtaaccccgccattgcttcattgatggcttttacagctgctgtcaccagcccactaaccactagccaaaccctcctcttcaacatattgggggggtgggtggctgcccagctcgccgcccccggtgccgctactgcctttgtgggcgctggcttagctggcgccgccatcggcagtgttggactggggaaggtcctcatagacatccttgcagggtatggcgcgggcgtggcgggagctcttgtggcattcaagatcatgagcggtgaggtcccctccacggaggacctggtcaatctactgcccgccatcctctcgcccggagccctcgtagtcggcgtggtctgtgcagcaatactgcgccggcacgttggcccgggcgagggggcagtgcagtggatgaaccggctgatagccttcgcctcccgggggaaccatgtttcccccacgcactacgtgccggagagcgatgcagctgcccgcgtcactgccatactcagcagcctcactgtaacccagctcctgaggcgactgcaccagtggataagctcggagtgtaccactccatgctccggttcctggctaagggacatctgggactggatatgcgaggtgttgagcgactttaagacctggctaaaagctaagctcatgccacagctgcctgggatcccctttgtgtcctgccagcgcgggtataagggggtctggcgagtggacggcatcatgcacactcgctgccactgtggagctgagatcactggacatgtcaaaaacgggacgatgaggatcgtcggtcctaggacctgcaggaacatgtggagtgggaccttccccattaatgcctacaccacgggcccctgtaccccccttcctgcgccgaactacacgttcgcgctatggagggtgtctgcagaggaatatgtggagataaggcaggtgggggacttccactacgtgacgggtatgactactgacaatctcaaatgcccgtgccaggtcccatcgcccgaatttttcacagaat

SEQ ID NO: 30 - protein, 859 aa
AYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGYTGDFDSVIDYNTCVTQTVDFSLDPTFTIETITLPQDAVSRTQRRGRTGRGKPGIYRFVAPGQRPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEITLTHPVTKYIMTCMSADLEVVTSTWVLVGGVLAALAAYCLSTGCVVIVGRVVLSGKPAIIPDREVLYREFDEMEECSQHLPYIEQGMMLAEQFKQKALGLLQTASRQAEVIAPAVQTNWQKLETFWAKHMWNFISGIQYLAGLSTLPGNPAIASLMAFTAAVTSPLTTSQTLLFNILGGWVAAQLAAPGAATAFVGAGLAGAAIGSVGLGKVLIDILAGYGAGVAGALVAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYKGVWRVDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTE

SEQ ID NO: 31 - DNA (cDNA), 800 bp; single-stranded, linear
  CDS 2..799
ggcggtggactttatccctgtggagaacctagagacaaccatgaggtccccggtgttcacggataactcctctccaccagtagtgccccagagcttccaggtggctcacctccatgctcccacaggcagcggcaaaagcaccaaggtcccggctgcatatgcagctcagggctataaggtgctagtactcaacccctctgttgctgcaacactgggctttggtgcttacatgtccaaggctcatgggatcgatcctaacatcaggaccggggtgagaacaattaccactggcagccccatcacgtactccacctacggcaagttccttgccgacggcgggtgctcggggggcgcttatgacataataatttgtgacgagtgccactccacggatgccacatccatcttgggcattggcactgtccttgaccaagcagagactgcgggggcgagactggttgtgctcgccaccgccacccctccgggctccgtcactgtgccccatcccaacatcgaggaggttgctctgtccaccaccggagagatccctttttacggcaaggctatccccctcgaagtaatcaagggggggagacatctcatcttctgtcattcaaagaagaagtgcgacgaactcgccgcaaagctggtcgcattgggcatcaatgccgtggcctactaccgcggtcttgacgtgtccgtcatcccgaccagcggcgatgttgtcgtcgtggcaaccgatgccctcatgaccggctataccggcgacttcgactcggtgatagactgcaatacgtgtg

SEQ ID NO: 32 - protein, 266 aa
AVDFIPVENLETTMRSPVFTDNSSPPVVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGYTGDFDSVIDCNTC

SEQ ID NO: 33 - DNA (cDNA), 283 bp; single-stranded, linear
  CDS 3..281
ctccctgcacttgcggctcctcggacctttacctggtcacgaggcacgccgatgtcattcccgtgcgccggcggggtgatagcaggggcagcctgctgtcgccccggcccatttcctacttgaaaggctcctcggggggtccgctgttgtgccccgcggggcacgccgtgggcatatttagggccgcggtgtgcacccgtggagtggctaaggcggtggactttatccctgtggagaacctagagacaaccatgaggtccccggtgttcacggataactcctc

SEQ ID NO: 34 - protein, 93 aa
PCTCGSSDLYLVTRHADVIPVRRRGDSRGSLLSPRPISYLKGSSGGPLLCPAGHAVGIFRAAVCTRGVAKAVDFIPVENLETTMRSPVFTDNS

SEQ ID NO: 35 - DNA (cDNA), 347 bp; single-stranded, linear
  CDS 2..346
ggggtggaggttgctggcgcccatcacggcgtacgcccagcagacaaggggcctcctagggtgcataatcaccagcctaactggccgggacaaaaaccaagtggagggtgaggtccagattgtgtcaactgctgcccaaaccttcctggcaacgtgcatcaatggggtgtgctggactgtctaccacggggccggaacgaggaccatcgcgtcacccaagggtcctgtcatccagatgtataccaatgtagaccaagaccttgtgggctggcccgctccgcaaggtagccgctcattgacaccctgcacttgcggctcctcggacctttacctggtcacgaggcacg

SEQ ID NO: 36 - protein, 115 aa
GWRLLAPITAYAQQTRGLLGCIITSLTGRDKNQVEGEVQIVSTAAQTFLATCINGVCWTVYHGAGTRTIASPKGPVIQMYTNVDQDLVGWPAPQGSRSLTPCTCGSSDLYLVTRH

SEQ ID NO: 37 - DNA (cDNA), 511 bp; single-stranded, linear
  CDS 2..511
gaacatgtggagtgggaccttccccattaatgcctacaccacgggcccctgtaccccccttcctgcgccgaactacacgttcgcgctatggagggtgtctgcagaggaatacgtggagataaggcaggtgggggacttccactacgtgacgggtatgactactgacaatcttaaatgcccgtgccaggtcccatcgcccgaatttttcacagaattggacggggtgcgcctacataggtttgcgcccccctgcaagcccttgctgcgggaggaggtatcattcagagtaggactccacgaatacccggtagggtcgcaattaccttgcgagcccgaaccggacgtggccgtgttgacgtccatgctcactgatccctcccatataacagcagaggcggccgggcgaaggttggcgaggggatcacccccctctgtggccagctcctcggctagccagctatccgctccatctctcaaggcaacttgcaccgctaaccatgactcccctgat

SEQ ID NO: 38 - protein, 170 aa
NMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPD

SEQ ID NO: 39 - DNA (cDNA), 378 bp; single-stranded, linear
  CDS 1..378
agctcctcggctagccagctatccgctccatctctcaaggcaacttgcaccgctaaccatgactcccctgatgctgagctcatagaggccaacctcctatggaggcaggagatgggcggcaacatcaccagggttgagtcagaaaacaaagtggtgattctggactccttcgatccgcttgtggcggaggaggacgagcgggagatctccgtacccgcagaaatcctgcggaagtctcggagattcgcccaggccctgcccgtttgggcgcggccggactataaccccccgctagtggagacgtggaaaaagcccgactacgaaccacctgtggtccatggctgtccgcttccacctccaaagtcccctcctgtgccg

SEQ ID NO: 40 - protein, 126 aa
SSSASQLSAPSLKATCTANHDSPDAELIEANLLWRQEMGGNITRVESENKVVILDSFDPLVAEEDEREISVPAEILRKSRRFAQALPVWARPDYNPPLVETWKKPDYEPPVVHGCPLPPPKSPPVP

SEQ ID NO: 41 - DNA (cDNA), 300 bp; single-stranded, linear
  CDS 2..298
cgtttgggcgcggccggactataaccccccgctagtggagacgtggaaaaaacccgactacgaaccacctgtggtccatggctgcccgcttccacctccaaagtcccctcctgtgcctccgcctcggaagaagcggacggtggtcctcactgaatcaaccctatctactgccttggccgagctcgccaccagaagctttggcagctcctcaacttccggcattacgggcgacaatacgacaacatcctctgagcccgccccttctggctgcccccccgactccgacgctgagtcctttgc

SEQ ID NO: 42 - protein, 99 aa
VWARPDYNPPLVETWKKPDYEPPVVHGCPLPPPKSPPVPPPRKKRTVVLTESTLSTALAELATRSFGSSSTSGITGDNTTTSSEPAPSGCPPDSDAESF

SEQ ID NO: 43 - DNA (cDNA), 352 bp; single-stranded, linear
  CDS 1..351
gcctccagaagctttggcagctcctcaacttccggcattacgggcgacaatacgacaacatcctctgagcccgccccttctggctgcccccccgactccgacgctgagtcctattcctccatgccccccctggagggggagcctggggatccggatcttagcgacgggtcatggtcaacggtcagtagtgaggccaacgcggaggatgtcgtgtgctgctcaatgtcttactcttggacaggcgcactcgtcaccccgtgcgccgcggaagaacagaaactgcccatcaatgcactaagcaactcgttgctacgtcaccacaatttggtgtattccaccacctcacgcagtg

SEQ ID NO: 44 - protein, 117 aa
ASRSFGSSSTSGITGDNTTTSSEPAPSGCPPDSDAESYSSMPPLEGEPGDPDLSDGSWSTVSSEANAEDVVCCSMSYSWTGALVTPCAAEEQKLPINALSNSLLRHHNLVYSTTSRS

SEQ ID NO: 45 - DNA (cDNA), 402 bp; single-stranded, linear
  CDS 1..402
ggcacctatgtttataaccatctcactcctcttcgggactgggcgcacaacggcttgcgagatctggccgtggctgtagagccagtcgtcttctcccaaatggagaccaagctcatcacgtggggggcagataccgccgcgtgcggtgacatcatcaacggcttgcctgtttccgcccgcaggggccgggagatactgctcgggccagccgatggaatggtctccaagggttggaggttgctggcgcccatcacggcgtacgcccagcagacaaggggcctcctagggtgcataatcaccagcctaactggccgggacaaaaaccaagtggagggtgaggtccagattgtgtcaactgctgcccaaaccttcctggcaacgtgcatcaatggggtgtgctgg

SEQ ID NO: 46 - protein, 134 aa
GTYVYNHLTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCW

SEQ ID NO: 47 - DNA (cDNA), 509 bp; single-stranded, linear
  CDS 1..507
ggcggtgttgttctcgtcgggttgatggcgctgactctgtcaccatattacaagcgctatatcagctggtgcttgtggtggcttcagtattttctgaccagagtggaagcgcaactgcacgtgtggattccccccctcaacgtccgaggggggcgcgacgccgtcatcttactcatgtgtgctgtacacccgactctggtatttgacatcaccaaattgctgctggccgtcttcggacccctttggattcttcaagccagtttgcttaaagtaccctactttgtgcgcgtccaaggccttctccggttctgcgcgttagcgcggaagatgatcggaggccattacgtgcaaatggtcatcattaagttaggggcgcttactggcacctatgtttataaccatctcactcctcttcgggactgggcgcacaacggcttgcgagatctggccgtggctgtagagccagtcgtcttctcccaaatggagaccaagctcatcacgtggggggc

SEQ ID NO: 48 - protein, 169 aa
GGVVLVGLMALTLSPYYKRYISWCLWWLQYFLTRVEAQLHVWIPPLNVRGGRDAVILLMCAVHPTLVFDITKLLLAVFGPLWILQASLLKVPYFVRVQGLLRFCALARKMIGGHYVQMVIIKLGALTGTYVYNHLTPLRDWAHNGLRDLAVAVEPVVFSQMETKLITWG

SEQ ID NO: 49 - DNA (cDNA), 397 bp; single-stranded, linear
  CDS 3..395
gggagtacgtcgttctcctgttccttctgcttgcagacgcgcgcgtctgctcctgcttgtggatgatgctactcatatcccaagcggaggcggctttggagaacctcgtaatacttaatgcagcatccctggccgggacgcacggtcttgtatccttcctcgtgttcttctgctttgcatggtatttgaagggtaagtgggtgcccggagcggtctacaccttctacgggatgtggcctctcctcctgctcctgttggcgttgccccagcgggcgtacgcgctggacacggaggtggccgcgtcgtgtggcggtgttgttctcgtcgggttgatggcgctgactctgtcaccatattacaagcgctatatcagctggtgcttgtggtggcttcagaa

SEQ ID NO: 50 - protein, 131 aa
EYVVLLFLLLADARVCSCLWMMLLISQAEAALENLVILNAASLAGTHGLVSFLVFFCFAWYLKGKWVPGAVYTFYGMWPLLLLLLALPQRAYALDTEVAASCGGVVLVGLMALTLSPYYKRYISWCLWWLQ

SEQ ID NO: 51 - DNA (cDNA), 396 bp; single-stranded, linear
  CDS 1..396
ccagccccttctggctgcccccccgactccgacgctgagtcctattcctccatgccccccctggagggggagcctggggatccggatcttagcgacgggtcatggtcaacagtcagtagtgaggccaacgcggaggatgtcgtgtgctgctcaatgtcctactcttggacaggcgcactcgtcaccccgtgcgccgcggaagaacagaaactgcccatcaatgcactgagcaactcgttgctacgtcaccacaatttggtgtattccaccacctcacgcagtgcttgccaaaggcagaagaaagtcacatttgacagactgcaagttctggacagccattaccaggacgtactcaaggaggttaaagcagcggcgtcaaaagtgaaggctaacttc

SEQ ID NO: 52 - protein, 132 aa
PAPSGCPPDSDAESYSSMPPLEGEPGDPDLSDGSWSTVSSEANAEDVVCCSMSYSWTGALVTPCAAEEQKLPINALSNSLLRHHNLVYSTTSRSACQRQKKVTFDRLQVLDSHYQDVLKEVKAAASKVKANF

SEQ ID NO: 53 - DNA (cDNA), 5360 bp; single-stranded, linear
  CDS 3..5360
gggagtacgtcgttctcctgttccttctgcttgcagacgcgcgcgtctgctcctgcttgtggatgatgctactcatatcccaagcggaggcggctttggagaacctcgtaatacttaatgcagcatccctggccgggacgcacggtcttgtatccttcctcgtgttcttctgctttgcatggtatttgaagggtaagtgggtgcccggagcggtctacaccttctacgggatgtggcctctcctcctgctcctgttggcgttgccccagcgggcgtacgcgctggacacggaggtggccgcgtcgtgtggcggtgttgttctcgtcgggttgatggcgctgactctgtcaccatattacaagcgctatatcagctggtgcttgtggtggcttcagtattttctgaccagagtggaagcgcaactgcacgtgtggattccccccctcaacgtccgaggggggcgcgacgccgtcatcttactcatgtgtgctgtacacccgactctggtatttgacatcaccaaattgctgctggccgtcttcggacccctttggattcttcaagccagtttgcttaaagtaccctactttgtgcgcgtccaaggccttctccggttctgcgcgttagcgcggaagatgatcggaggccattacgtgcaaatggtcatcattaagttaggggcgcttactggcacctatgtttataaccatctcactcctcttcgggactgggcgcacaacggcttgcgagatctggccgtggctgtagagccagtcgtcttctcccaaatggagaccaagctcatcacgtggggggcagataccgccgcgtgcggtgacatcatcaacggcttgcctgtttccgcccgcaggggccgggagatactgctcgggccagccgatggaatggtctccaaggggtggaggttgctggcgcccatcacggcgtacgcccagcagacaaggggcctcctagggtgcataatcaccagcctaactggccgggacaaaaaccaagtggagggtgaggtccagattgtgtcaactgctgcccaaaccttcctggcaacgtgcatcaatggggtgtgctggactgtctaccacggggccggaacgaggaccatcgcgtcacccaagggtcctgtcatccagatgtataccaatgtagaccaagaccttgtgggctggcccgctccgcaaggtagccgctcattgacaccctgcacttgcggctcctcggacctttacctggtcacgaggcacgccgatgtcattcccgtgcgccggcggggtgatagcaggggcagcctgctgtcgccccggcccatttcctacttgaaaggctcctcggggggtccgctgttgtgccccgcggggcacgccgtgggcatatttagggccgcggtgtgcacccgtggagtggctaaggcggtggactttatccctgtggagaacctagagacaaccatgaggtccccggtgttcacggataactcctctccaccagtagtgccccagagcttccaggtggctcacctccatgctcccacaggcagcggcaaaagcaccaaggtcccggctgcatatgcagctcagggctataaggtgctagtactcaacccctctgttgctgcaacactgggctttggtgcttacatgtccaaggctcatgggatcgatcctaacatcaggaccggggtgagaacaattaccactggcagccccatcacgtactccacctacggcaagttccttgccgacggcgggtgctcggggggcgcttatgacataataatttgtgacgagtgccactccacggatgccacatccatcttgggcatcggcactgtccttgaccaagcagagactgcgggggcgagactggttgtgctcgccaccgccacccctccgggctccgtcactgtgccccatcccaacatcgaggaggttgctctgtccaccaccggagagatccctttttacggcaaggctatccccctcgaagtaatcaagggggggagacatctcatcttctgtcattcaaagaagaagtgcgacgaactcgccgcaaagctggtcgcattgggcatcaatgccgtggcctactaccgcggtcttgagctgtccgtcatcccgaccagcggcgatgttgtcgtcgtggcaaccgatgccctcatgaccggctataccggcgacttcgactcggtgatagactgcaatacgtgtgtcacccagacagtcgatttcagccttgaccctaccttcaccattgagacaatcacgctcccccaggatgctgtctcccgcactcaacgtcggggcaggactggcagggggaagccaggcatctacagatttgtggcaccgggggagcgcccctccggcatgttcgactcgtccgtcctctgtgagtgctatgacgcaggctgtgcttggtatgagctcacgcccgccgagactacagttaggctacgagcgtacatgaacaccccggggcttcccgtgtgccaggaccatcttgaattttgggagggcgtctttacaggcctcactcatatagatgcccactttctatcccagacaaagcagagtggggagaaccttccttacctggtagcgtaccaagccaccgtgtgcgctagggctcaagcccctcccccatcgtgggaccagatgtggaagtgtttgattcgcctcaagcccaccctccatgggccaacacccctgctatacagactgggcgctgttcagaatgaaatcaccctgacgcacccagtcaccaaatacatcatgacatgcatgtcggccgacctggaggtcgtcacgagcacctgggtgctcgttggcggcgtcctgtctgctttggccgcgtattgcctgtcaacaggctgcgtggtcatagtgggcagggtcgtcttgtccgggaagccggcaatcatacctgacagggaagtcctctaccgagagttcgatgagatggaagagtcctctcagcacttaccgtacatcgagcaagggatgatgctcgccgagcagttcaagcagaaggccctcggcctgctgcagaccgcgtcccgtcaggcagaggttatcgccccgtgctgtccaaccaactggcaaaaactcgagaccttctgggcgaagcatatgtggaacttcatcagtgggatacaatacttggcgggcttgtcaacgctgcctggtaaccccgccattgcttcattgatggcttttacagctgctgtcaccagcccactaaccactagccaaaccctcctcttcaacatattgggggggtgggtggctgcccagctcgccgcccccggtgccgctactgcctttgtgggcgctggcttagctggcgccgccatcggcagtgttggactggggaaggtcctcatagacatccttgcagggtatggcgcgggcgtggcgggagctcttgtggcattcaagatcatgagcggtgaggtcccctccacggaggacctggtcaatctactgcccgccatcctctcgcccggagccctcgtagtcggcgtggtctgtgcagcaatactgcgccggcacgttggcccgggcgagggggcagtgcagtggatgaaccggctgatagccttcgcctcccgggggaaccatgtttcccccacgcactacgtgccggagagcgatgcagctgcccgcgtcactgccatactcagcagcctcactgtaacccagctcctgaggcgactgcaccagtggataagctcggagtgtaccactccatgctccggttcctggctaagggacatctgggactggatatgcgaggtgttgagcgactttaagacctggctaaaagctaagctcatgccacagctgcctgggatcccctttgtgtcctgccagcgcgggtataagggggtctggcgagtggacggcatcatgcacactcgctgccactgtggagctgagatcactggacatgtcaaaaacgggacgatgaggatcgtcggtcctaggacctgcaggaacatgtggagtgggaccttccccattaatgcctacaccacgggcccctgtaccccccttcctgcgccgaactacacgttcgcgctatggagggtgtctgcagaggaatatgtggagataaggcaggtgggggacttccactacgtgacgggtatgactactgacaatctcaaatgcccgtgccaggtcccatcgcccgaatttttcacagaattggacggggtgcgcctacataggtttgcgcccccctgcaagcccttgctgcgggaggaggtatcattcagagtaggactccacgaatacccggtagggtcgcaattaccttgcgagcccgaaccggacgtggccgtgttgacgtccatgctcactgatccctcccatataacagcagaggcggccgggcgaaggttggcgaggggatcacccccctctgtggccagctcctcggctagccagctatccgctccatctctcaaggcaacttgcaccgctaaccatgactcccctgatgctgagctcatagaggccaacctcctatggaggcaggagatgggcggcaacatcaccagggttgagtcagaaaacaaagtggtgattctggactccttcgatccgcttgtggcggaggaggacgagcgggagatctccgtacccgcagaaatcctgcggaagtctcggagattcgcccaggccctgcccgtttgggcgcggccggactataaccccccgctagtggagacgtggaaaaagcccgactacgaaccacctgtggtccatggctgtccgcttccacctccaaagtcccctcctgtgcctccgcctcggaagaagcggacggtggtcctcactgaatcaaccctatctactgccttggccgagctcgccaccagaagctttggcagctcctcaacttccggcattacgggcgacaatacgacaacatcctctgagcccgccccttctggctgcccccccgactccgacgctgagtcctattcctccatgccccccctggagggggagcctggggatccggatcttagcgacgggtcatggtcaacggtcagtagtgtggccaacgcggaggatgtcgtgtgctgctcaatgtcttactcttggacaggcgcactcgtcaccccgtgcgccgcggaagaacagaaactgcccatcaatgcactaagcaactcgttgctacgtcaccacaatttggtgtattccaccacctcacgcagtgcttgccaaaggcagaagaaagtcacatttgacagactgcaagttctggacagccattaccaggacgtactcaaggaggttaaagcagcggcgtcaaaagtgaaggctaacttg

SEQ ID NO: 54 - protein, 1786 aa
EYVVLLFLLLADARVCSCLWMMLLISQAEAALENLVILNAASLAGTHGLVSFLVFFCFAWYLKGKWVPGAVYTFYGMWPLLLLLLALPQRAYALDTEVAASCGGVVLVGLMALTLSPYYKRYISWCLWWLQYFLTRVEAQLHVWIPPLNVRGGRDAVILLMCAVHPTLVFDITKLLLAVFGPLWILQASLLKVPYFVRVQGLLRFCALARKMIGGHYVQMVIIKLGALTGTYVYNHLTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVENLETTMRSPVFTDNSSPPVVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLELSVIPTSGDVVVVATDALMTGYTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEITLTHPVTKYIMTCMSADLEVVTSTWVLVGGVLSALAAYCLSTGCVVIVGRVVLSGKPAIIPDREVLYREFDEMEESSQHLPYIEQGMMLAEQFKQKALGLLQTASRQAEVIAPCCPTNWQKLETFWAKHMWNFISGIQYLAGLSTLPGNPAIASLMAFTAAVTSPLTTSQTLLFNILGGWVAAQLAAPGAATAFVGAGLAGAAIGSVGLGKVLIDILAGYGAGVAGALVAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYKGVWRVDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGGNITRVESENKVVILDSFDPLVAEEDEREISVPAEILRKSRRFAQALPVWARPDYNPPLVETWKKPDYEPPVVHGCPLPPPKSPPVPPPRKKRTVVLTESTLSTALAELATRSFGSSSTSGITGDNTTTSSEPAPSGCPPDSDAESYSSMPPLEGEPGDPDLSDGSWSTVSSVANAEDVVCCSMSYSWTGALVTPCAAEEQKLPINALSNSLLRHHNLVYSTTSRSACQRQKKVTFDRLQVLDSHYQDVLKEVKAAASKVKANL

SEQ ID NO: 55 - DNA (cDNA), 427 bp; single-stranded, linear
  CDS 3..425
ccatatttaaaatcaggatgtacgtgggaggggtcgaacacaggctggaagctgcctgcaactggacgcggggcgaacgttgcgatctggaagacagggacaggtccgagctcagcccgttactgctgaccactacacagtggcaggtcctcccgtgttccttcacaaccctaccagccttgtccaccggcctcatccacctccaccagaacattgtggacgtgcagtacttgtacggggtggggtcaagcatcgcgtcctgggccattaagtgggagtacgtcgttctcctgttccttctgcttgcagacgcgcgcgtctgctcctgcttgtggatgatgctactcatatcccaagcggaggcggctttggagaacctcgtaatacttaatgcagcatccctggccgggacgcacggtcttgtatc

SEQ ID NO: 56 - protein, 141 aa
IFKIRMYVGGVEHRLEAACNWTRGERCDLEDRDRSELSPLLLTTTQWQVLPCSFTTLPALSTGLIHLHQNIVDVQYLYGVGSSIASWAIKWEYVVLLFLLLADARVCSCLWMMLLISQAEAALENLVILNAASLAGTHGLV

SEQ ID NO: 57 - DNA (cDNA), 515 bp; single-stranded, linear
  CDS 3..515
tgctcaaggaggttaaagcagcggcgtcaaaagtgaaggctaacttgctatccgtagaggaagcttgcagcctgacgcccccacactcagccaaatccaagtttggttatggggcaaaagacgtccgttgccatgccagaaaggccgtaacccacatcaactccgtgtggaaagaccttctggaagacaatgtaacaccactagacactaccatcatggctaagaacgaggttttctgcgttcagcctgagaaggggggtcgtaagccagctcgtctcatcgtgttccccgatctgggcgtgcgcgtgtgcgaaaagatggctttgtacgacgtggttacaaagctccccttggccgtgatgggaagctcctacggattccaatactcaccaggacagcgggttgaattcctcgtgcaagcgtggaagtccaagaaaaccccaatggggttctcgtatgatacccgctgctttgactccacagtcactgagagcgacatccgtacggaggaggca

SEQ ID NO: 58 - protein, 171 aa
LKEVKAAASKVKANLLSVEEACSLTPPHSAKSKFGYGAKDVRCHARKAVTHINSVWKDLLEDNVTPLDTTIMAKNEVFCVQPEKGGRKPARLIVFPDLGVRVCEKMALYDVVTKLPLAVMGSSYGFQYSPGQRVEFLVQAWKSKKTPMGFSYDTRCFDSTVTESDIRTEEA

SEQ ID NO: 59 - DNA (cDNA), 401 bp; single-stranded, linear
  CDS 1..399
gaattcctcgtgcaagcgtggaagtccaagaaaaccccaatggggttctcgtatgatacccgctgctttgactccacagtcactgagagcgacatccgtacggaggaggcaatctaccaatgttgtgacctcgacccccaagcccgcgtggccatcaagtccctcaccgagaggctttatgttgggggccctcttaccaattcaaggggggagaactgcggctatcgcaggtgccgcgcgagcggcgtactgacaactagctgtggtaacaccctcacttgctacatcaaggccccggcagcctgtcgagccgcagggctccaggactgcaccatgctcgtgtgtggcgacgacttagtcgttatctgtgaaagcgcgggggtccaggaggacgcggcgag

SEQ ID NO: 60 - protein, 133 aa
EFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKAPAACRAAGLQDCTMLVCGDDLVVICESAGVQEDAA

SEQ ID NO: 61 - DNA (cDNA), 456 bp; single-stranded, linear
  CDS 1..456
gggggggagaactgcggctatcgcaggtgccgcgcaagcggcgtactgacaactagctgtggtaacaccctcacttgttacatcaaggcccgagcagcctgtcgagccgcagggctccaggactgcaccatgctcgtgtgtggcgacgacttagtcgttatctgtgaaagcgcgggggtccaggaggacgcggcgagcctgagagccttcacggaggctatgaccaggtactccgccccccctggggaccccccacaaccagaatacgacttggagctcataacatcatgctcctccaacgtgtcagtcgcccacgacggcgctggaaagagggtctactacctcacccgtgaccctacaacccccctcgcgagagctgcgtgggagacagcaagacacactccagtcaattcctggctaggcaacataatcatgtttgcccccacactgtgggcg

SEQ ID NO: 62 - protein, 152 aa
GGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWA

SEQ ID NO: 63 - DNA (cDNA), 274 bp; single-stranded, linear
  CDS 2..274
cggcgctggaaagagggtctactacctcacccgtgaccctacaacccccctcgcgagagctgcgtgggagacagcaagacacactccagtcaattcctggctaggcaacataatcatgtttgcccccacactgtgggcgaggatgatactgatgacccatttctttagcgtccttatagccagggaccagcttgaacaggccctcgattgcgagatctacggggcctgctactccatagaaccacttgatctacctccaatcattcaaagactc

SEQ ID NO: 64 - protein, 91 aa
GAGKRVYYLTRDPTTPLARAAWETARHTPVNSWLGNIIMFAPTLWARMILMTHFFSVLIARDQLEQALDCEIYGACYSIEPLDLPPIIQRL

SEQ ID NO: 65 - DNA (cDNA), 6785 bp; single-stranded, linear
  CDS 3..6785
ccatatttaaaatcaggatgtacgtgggaggggtcgaacacaggctggaagctgcctgcaactggacgcggggcgaacgttgcgatctggaagacagggacaggtccgagctcagcccgttactgctgaccactacacagtggcaggtcctcccgtgttccttcacaaccctaccagccttgtccaccggcctcatccacctccaccagaacattgtggacgtgcagtacttgtacggggtggggtcaagcatcgcgtcctgggccattaagtgggagtacgtcgttctcctgttccttctgcttgcagacgcgcgcgtctgctcctgcttgtggatgatgctactcatatcccaagcggaggcggctttggagaacctcgtaatacttaatgcagcatccctggccgggacgcacggtcttgtatccttcctcgtgttcttctgctttgcatggtatttgaagggtaagtgggtgcccggagcggtctacaccttctacgggatgtggcctctcctcctgctcctgttggcgttgccccagcgggcgtacgcgctggacacggaggtggccgcgtcgtgtggcggtgttgttctcgtcgggttgatggcgctgactctgtcaccatattacaagcgctatatcagctggtgcttgtggtggcttcagtattttctgaccagagtggaagcgcaactgcacgtgtggattccccccctcaacgtccgaggggggcgcgacgccgtcatcttactcatgtgtgctgtacacccgactctggtatttgacatcaccaaattgctgctggccgtcttcggacccctttggattcttcaagccagtttgcttaaagtaccctactttgtgcgcgtccaaggccttctccggttctgcgcgttagcgcggaagatgatcggaggccattacgtgcaaatggtcatcattaagttaggggcgcttactggcacctatgtttataaccatctcactcctcttcgggactgggcgcacaacggcttgcgagatctggccgtggctgtagagccagtcgtcttctcccaaatggagaccaagctcatcacgtggggggcagataccgccgcgtgcggtgacatcatcaacggcttgcctgtttccgcccgcaggggccgggagatactgctcgggccagccgatggaatggtctccaaggggtggaggttgctggcgcccatcacggcgtacgcccagcagacaaggggcctcctagggtgcataatcaccagcctaactggccgggacaaaaaccaagtggagggtgaggtccagattgtgtcaactgctgcccaaaccttcctggcaacgtgcatcaatggggtgtgctggactgtctaccacggggccggaacgaggaccatcgcgtcacccaagggtcctgtcatccagatgtataccaatgtagaccaagaccttgtgggctggcccgctccgcaaggtagccgctcattgacaccctgcacttgcggctcctcggacctttacctggtcacgaggcacgccgatgtcattcccgtgcgccggcggggtgatagcaggggcagcctgctgtcgccccggcccatttcctacttgaaaggctcctcggggggtccgctgttgtgccccgcggggcacgccgtgggcatatttagggccgcggtgtgcacccgtggagtggctaaggcggtggactttatccctgtggagaacctagagacaaccatgaggtccccggtgttcacggataactcctctccaccagtagtgccccagagcttccaggtggctcacctccatgctcccacaggcagcggcaaaagcaccaaggtcccggctgcatatgcagctcagggctataaggtgctagtactcaacccctctgttgctgcaacactgggctttggtgcttacatgtccaaggctcatgggatcgatcctaacatcaggaccggggtgagaacaattaccactggcagccccatcacgtactccacctacggcaagttccttgccgacggcgggtgctcggggggcgcttatgacataataatttgtgacgactgccactccacggatgccacatccatcttgggcatcggcactgtccttgaccaagcagagactgcgggggcgagactggttgtgctcgccaccgccacccctccgggctccgtcactgtgccccatcccaacatcgaggaggttgctctgtccaccaccggagagatccctttttacggcaaggctatccccctcgaagtaatcaagggggggagacatctcatcttctgtcattcaaagaagaagtgcgacgaactcgccgcaaagctggtcgcattgggcatcaatgccgtggcctactaccgcggtcttgacgtgtccgtcatcccgaccagcggcgatgttgtcgtcgtggcaaccgatgccctcatgaccggctataccggcgacttcgactcggtgatagactgcaatacgtgtgtcacccagacagtcgatttcagccttgaccctaccttcaccattgagacaatcacgctcccccaggatgctgtctcccgcactcaacgtcggggcaggactggcagggggaagccaggcatctacagatttgtggcaccgggggagcgcccctccggcatgttcgactcgtccgtcctctgtgagtgctatgacgcaggctgtgcttggtatgagctcacgcccgccgagactacagttaggctacgagcgtacatgaacaccccggggcttcccgtgtgccaggaccatcttgaattttgggagggcgtctttacaggcctcactcatatagatgcccactttctatcccagacaaagcagagtggggagaaccttccttacctggtagcgtaccaagccaccgtgtgcgctagggctcaagcccctcccccatcgtgggaccagatgtggaagtgtttgattcgcctcaagcccaccctccatgggccaacacccctgctatacagactgggcgctgttcagaatgaaatcaccctgacgcacccagtcaccaaatacatcatgacatgcatgtcggccgacctggaggtcgtcacgagcacctgggtgctcgttggcggcgtcctggctgctttggccgcgtattgcctgtcaacaggctgcgtggtcatagtgggcagggtcgtcttgtccgggaagccggcaatcatacctgacagggaagtcctctaccgagagttcgatgagatggaagagtgctctcagcacttaccgtacatcgagcaagggatgatgctcgccgagcagttcaagcagaaggccctcggcctcctgcagaccgcgtcccgtcaggcagaggttatcgcccctgctgtccagaccaactggcaaaaactcgagaccttctgggcgaagcatatgtggaacttcatcagtgggatacaatacttggcgggcttgtcaacgctgcctggtaaccccgccattgcttcattgatggcttttacagctgctgtcaccagcccactaaccactagccaaaccctcctcttcaacatattgggggggtgggtggctgcccagctcgccgcccccggtgccgctactgcctttgtgggcgctggcttagctggcgccgccatcggcagtgttggactggggaaggtcctcatagacatccttgcagggtatggcgcgggcgtggcgggagctcttgtggcattcaagatcatgagcggtgaggtcccctccacggaggacctggtcaatctactgcccgccatcctctcgcccggagccctcgtagtcggcgtggtctgtgcagcaatactgcgccggcacgttggcccgggcgagggggcagtgcagtggatgaaccggctgatagccttcgcctcccgggggaaccatgtttcccccacgcactacgtgccggagagcgatgcagctgcccgcgtcactgccatactcagcagcctcactgtaacccagctcctgaggcgactgcaccagtggataagctcggagtgtaccactccatgctccggttcctggctaagggacatctgggactggatatgcgaggtgttgagcgactttaagacctggctaaaagctaagctcatgccacagctgcctgggatcccctttgtgtcctgccagcgcgggtataagggggtctggcgagtggacggcatcatgcacactcgctgccactgtggagctgagatcactggacatgtcaaaaacgggacgatgaggatcgtcggtcctaggacctgcaggaacatgtggagtgggaccttccccattaatgcctacaccacgggcccctgtaccccccttcctgcgccgaactacacgttcgcgctatggagggtgtctgcagaggaatatgtggagataaggcaggtgggggacttccactacgtgacgggtatgactactgacaatctcaaatgcccgtgccaggtcccatcgcccgaatttttcacagaattggacggggtgcgcctacataggtttgcgcccccctgcaagcccttgctgcgggaggaggtatcattcagagtaggactccacgaatacccggtagggtcgcaattaccttgcgagcccgaaccggacgtggccgtgttgacgtccatgctcactgatccctcccatataacagcagaggcggccgggcgaaggttggcgaggggatcacccccctctgtggccagctcctcggctagccagctatccgctccatctctcaaggcaacttgcaccgctaaccatgactcccctgatgctgagctcatagaggccaacctcctatggaggcaggagatgggcggcaacatcaccagggttgagtcagaaaacaaagtggtgattctggactccttcgatccgcttgtggcggaggaggacgagcgggagatctccgtacccgcagaaatcctgcggaagtctcggagattcgcccaggccctgcccgtttgggcgcggccggactataaccccccgctagtggagacgtggaaaaagcccgactacgaaccacctgtggtccatggctgtccgcttccacctccaaagtcccctcctgtgcctccgcctcggaagaagcggacggtggtcctcactgaatcaaccctatctactgccttggccgagctcgccaccagaagctttggcagctcctcaacttccggcattacgggcgacaatacgacaacatcctctgagcccgccccttctggctgcccccccgactccgacgctgagtcctattcctccatgccccccctggagggggagcctggggatccggatcttagcgacgggtcatggtcaacggtcagtagtgaggccaacgcggaggatgtcgtgtgctgctcaatgtcttactcttggacaggcgcactcgtcaccccgtgcgccgcggaagaacagaaactgcccatcaatgcactaagcaactcgttgctacgtcaccacaatttggtgtattccaccacctcacgcagtgcttgccaaaggcagaagaaagtcacatttgacagactgcaagttctggacagccattaccaggacgtactcaaggaggttaaagcagcggcgtcaaaagtgaaggctaacttgctatccgtagaggaagcttgcagcctgacgcccccacactcagccaaatccaagtttggttatggggcaaaagacgtccgttgccatgccagaaaggccgtaacccacatcaactccgtgtggaaagaccttctggaagacaatgtaacaccaatagacactaccatcatggctaagaacgaggttttctgcgttcagcctgagaaggggggtcgtaagccagctcgtctcatcgtgttccccgatctgggcgtgcgcgtgtgcgaaaagatggctttgtacgacgtggttacaaagctccccttggccgtgatgggaagctcctacggattccaatactcaccaggacagcgggttgaattcctcgtgcaagcgtggaagtccaagaaaaccccaatggggttctcgtatgatacccgctgctttgactccacagtcactgagagcgacatccgtacggaggaggcaatctaccaatgttgtgacctcgacccccaagcccgcgtggccatcaagtccctcaccgagaggctttatgttgggggccctcttaccaattcaaggggggagaactgcggctatcgcaggtgccgcgcgagcggcgtactgacaactagctgtggtaacaccctcacttgctacatcaaggcccgggcagcctgtcgagccgcagggctccaggactgcaccatgctcgtgtgtggcgacgacttagtcgttatctgtgaaagcgcgggggtccaggaggacgcggcgagcctgagagccttcacggaggctatgaccaggtactccgccccccctggggaccccccacaaccagaatacgacttggagctcataacatcatgctcctccaacgtgtcagtcgcccacgacggcgctggaaagagggtctactacctcacccgtgaccctacaacccccctcgcgagagctgcgtgggagacagcaagacacactccagtcaattcctggctaggcaacataatcatgtttgcccccacactgtgggcgaggatgatactgatgacccatttctttagcgtccttatagccagggaccagcttgaacaggccctcgattgcgagatctacggggcctgctactccatagaaccacttgatctacctccaatcattcaaagactc

SEQ ID NO: 66 - protein, 2261 aa
IFKIRMYVGGVEHRLEAACNWTRGERCDLEDRDRSELSPLLLTTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGKWVPGAVYTFYGMWPLLLLLLALPQRAYALDTEVAASCGGVVLVGLMALTLSPYYKRYISWCLWWLQYFLTRVEAQLHVWIPPLNVRGGRDAVILLMCAVHPTLVFDITKLLLAVFGPLWILQASLLKVPYFVRVQGLLRFCALARKMIGGHYVQMVIIKLGALTGTYVYNHLTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVENLETTMRSPVFTDNSSPPVVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDDCHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGYTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEITLTHPVTKYIMTCMSADLEVVTSTWVLVGGVLAALAAYCLSTGCVVIVGRVVLSGKPAIIPDREVLYREFDEMEECSQHLPYIEQGMMLAEQFKQKALGLLQTASRQAEVIAPAVQTNWQKLETFWAKHMWNFISGIQYLAGLSTLPGNPAIASLMAFTAAVTSPLTTSQTLLFNILGGWVAAQLAAPGAATAFVGAGLAGAAIGSVGLGKVLIDILAGYGAGVAGALVAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYKGVWRVDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGGNITRVESENKVVILDSFDPLVAEEDEREISVPAEILRKSRRFAQALPVWARPDYNPPLVETWKKPDYEPPVVHGCPLPPPKSPPVPPPRKKRTVVLTESTLSTALAELATRSFGSSSTSGITGDNTTTSSEPAPSGCPPDSDAESYSSMPPLEGEPGDPDLSDGSWSTVSSEANAEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVTHINSVWKDLLEDNVTPIDTTIMAKNEVFCVQPEKGGRKPARLIVFPDLGVRVCEKMALYDVVTKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRL

SEQ ID NO: 67 - DNA (cDNA), 1310 bp; single-stranded, linear
  CDS 1..1146
  immediate source clone: composite of clones 36, 81, and 32
gcttgtggtgtaattgggatcgcccagaatttgggaattcgggatgcccactttctatcccagacaaagcagagtggggagaaccttccttacctggtagcgtaccaagccaccgtgtgcgctagggctcaagcccctcccccatcgtgggaccagatgtggaagtgtttgattcgcctcaagcccaccctccatgggccaacacccctgctatacagactgggcgctgttcagaatgaaatcaccctgacgcacccagtcaccaaatacatcatgacatgcatgtcggccgacctggaggtcgtcacgagcacctgggtgctcgttggcggcgtcctggctgctttggccgcgtattgcctgtcaacaggctgcgtggtcatagtgggcagggtcgtcttgtccgggaagccggcaatcatacctgacagggaagtcctctaccgagagttcgatgagatggaagagtgctctcagcacttaccgtacatcgagcaagggatgatgctcgccgagcagttcaagcagaaggccctcggcctcctgcagaccgcgtcccgtcaggcagaggttatcgcccctgctgtccagaccaactggcaaaaactcgagaccttctgggcgaagcatatgtggaacttcatcagtgggatacaatacttggcgggcttgtcaacgctgcctggtaaccccgccattgcttcattgatggcttttacagctgctgtcaccagcccactaaccactagccaaaccctcctcttcaacatattgggggggtgggtggctgcccagctcgccgcccccggtgccgctactgcctttgtgggcgctggcttagctggcgccgccatcggcagtgttggactggggaaggtcctcatagacatccttgcagggtatggcgcgggcgtggcgggagctcttgtggcattcaagatcatgagcggtgaggtcccctccacggaggacctggtcaatctactgcccgccatcctctcgcccggagccctcgtagtcggcgtggtctgtgcagcaatactgcgccggcacgttggcccgggcgagggggcagtgcagtggatgaaccggctgatagccttcgcctcccgggggaaccatgtttccccagtccatcataagcgttgacgctccctacgggtggactgtggagagacagggcactgctaaggcccaaatctcagccatgcatcgaggggtacaatccgtatggccaacaactagcgcgtacgtaaagtctcctttctcgatggtccataccttagatgcgttagcattaatccgaattc

SEQ ID NO: 68 - protein, 382 aa
ACGVIGIAQNLGIRDAHFLSQTKQSGENLPYLVAYQATVCARAQAPPPSWDQMWKCLIRLKPTLHGPTPLLYRLGAVQNEITLTHPVTKYIMTCMSADLEVVTSTWVLVGGVLAALAAYCLSTGCVVIVGRVVLSGKPAIIPDREVLYREFDEMEECSQHLPYIEQGMMLAEQFKQKALGLLQTASRQAEVIAPAVQTNWQKLETFWAKHMWNFISGIQYLAGLSTLPGNPAIASLMAFTAAVTSPLTTSQTLLFNILGGWVAAQLAAPGAATAFVGAGLAGAAIGSVGLGKVLIDILAGYGAGVAGALVAFKIMSGEVPSTEDLVNLLPAILSPGALVVGVVCAAILRRHVGPGEGAVQWMNRLIAFASRGNHVSPVHHKR

SEQ ID NO: 69 - protein, 829 aa
EYVVLLFLLLADARVCSCLWMMLLISQAEAALENLVILNAASLAGTHGLVSFLVFFCFAWYLKGKWVPGAVYTFYGMWPLLLLLLALPQRAYALDTEVAASCGGVVLVGLMALTLSPYYKRYISWCLWWLQYFLTRVEAQLHVWIPPLNVRGGRDAVILLMCAVHPTLVFDITKLLLAVFGPLWILQASLLKVPYFVRVQGLLRFCALARKMIGGHYVQMVIIKLGALTGTYVYNHLTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVENLETTMRSPVFTDNSSPPVVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLELSVIPTSGDVVVVATDALMTGYTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNT

SEQ ID NO: 70 - protein, 765 aa, Dengue flavivirus(MNWVD1)
AVSFVTLITGNMSFRDLGRVMVMVGATMTDDIGMGVTYLALLAAFKVRPTFAAGLLLRKLTSKELMMTTIGIVLLSQSTIPETILELTDALALGMMVLKMVRKMEKYQLAVTIMAILCVPNAVILQNAWKVSCTILAVVSVSPLFLTSSQQKADWIPLALTIKGLNPTAIFLTTLSRTNKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLVSCGGGWKLEGEWKEGEEVQVLALEPGKNPRAVQTKPGLFKTNAGTIGAVSLDFSPGTSGSPIIDKKGKVVGLYGNGVVTRSGAYVSAIAQTEKSIEDNPEIEDDIFRKRKLTIMDLHPGAGKTKRYLPAIVRGAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWSSGHEWVTDFKGKTVWFVPSIKAGNDTAACLRKNGKKVTQLSRKTFDSEYVKTRTNDWNFVVTTDISEMGANFKAERVIDPRRCMKPVILTDGEERVILAGPMPVTHSS

SEQ ID NO: 71 - DNA (genomic), 16 bp; single-stranded, linear
aagcttgatcgaattc

SEQ ID NO: 72 - DNA (cDNA), 1366 bp; single-stranded, linear
  CDS 3..1364
  immediate source clone: k9-1
caggctgtcctgagaggctagccagctgccgaccccttaccgattttgaccagggctggggccctatcagttatgccaacggaagcggccccgaccagcgcccctactgctggcactaccccccaaaaccttgcggtattgtgcccgcgaagagtgtgtgtggtccggtatattgcttcactcccagccccgtggtggtgggaacgaccgacaggtcgggcgcgcccacctacagctggggtgaaatagatacggacgtcttcgtccttaacaataccaggccaccgctgggcaattggttcggttgtacctggatgaactcaactggattcaccaaagtgtgcggagcgcctccttgtgtcatcggaggggcgggcaacaacaccctgcactgccccactgattgcttccgcaagcatccggacgccacatactctcggtgcggctccggtccctggatcacacccaggtgcctggtcgactacccgtataggctttggcattatccttgtaccatcaactacactatatttaaaatcaggatgtacgtgggaggggtcgagcacaggctggaagctgcctgcaactggacgcggggcgaacgttgcgatctggaagatagggacaggtccgagctcagcccgttactgctgaccactacacagtggcaggtcctcccgtgttccttcacaaccctgccagccttgtccaccggcctcatccacctccaccagaacattgtggacgtgcagtacttgtacggggtggggtcaagcatcgcgtcctgggccattaagtgggagtacgtcgtcctcctgttccttctgcttgcagacgcgcgcgtctgctcctgcttgtggatgatgctactcatatcccaagcggaagcggctttggagaacctcgtaatacttaatgcagcatccctggccgggacgcacggtcttgtatccttcctcgtgttcttctgctttgcatggtatctgaagggtaagtgggtgcccggagcggtctacaccttctacgggatgtggcctctcctcctgctcctgttggcgttgccccagcgggcgtacgcgctggacacggaggtggccgcgtcgtgtggcggtgttgttctcgtcgggttgatggcgctaactctgtcaccatattacaagcgctatatcagctggtgcttgtggtggcttcagtattttctgaccagagtggaagcgcaactgcacgtgtggattccccccctcaacgtccgaggggggcgcgacgctgtcatcttactcatgtgtgctgtacacccgactctggtatttgacatcaccaaattgctgctggccgtcttcggacccctttggattcttcaagccag

SEQ ID NO: 73 - protein, 454 aa
GCPERLASCRPLTDFDQGWGPISYANGSGPDQRPYCWHYPPKPCGIVPAKSVCGPVYCFTPSPVVVGTTDRSGAPTYSWGEIDTDVFVLNNTRPPLGNWFGCTWMNSTGFTKVCGAPPCVIGGAGNNTLHCPTDCFRKHPDATYSRCGSGPWITPRCLVDYPYRLWHYPCTINYTIFKIRMYVGGVEHRLEAACNWTRGERCDLEDRDRSELSPLLLTTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGKWVPGAVYTFYGMWPLLLLLLALPQRAYALDTEVAASCGGVVLVGLMALTLSPYYKRYISWCLWWLQYFLTRVEAQLHVWIPPLNVRGGRDAVILLMCAVHPTLVFDITKLLLAVFGPLWILQA

SEQ ID NO: 74 - DNA (cDNA), 7310 bp; single-stranded, linear
  CDS 3..7310
caggctgtcctgagaggctagccagctgccgaccccttaccgattttgaccagggctggggccctatcagttatgccaacggaagcggccccgaccagcgcccctactgctggcactaccccccaaaaccttgcggtattgtgcccgcgaagagtgtgtgtggtccggtatattgcttcactcccagccccgtggtggtgggaacgaccgacaggtcgggcgcgcccacctacagctggggtgaaaatgatacggacgtcttcgtccttaacaataccaggccaccgctgggcaattggttcggttgtacctggatgaactcaactggattcaccaaagtgtgcggagcgcctccttgtgtcatcggaggggcgggcaacaacaccctgcactgccccactgattgcttccgcaagcatccggacgccacatactctcggtgcggctccggtccctggatcacacccaggtgcctggtcgactacccgtataggctttggcattatccttgtaccatcaactacaccatatttaaaatcaggatgtacgtgggaggggtcgaacacaggctggaagctgcctgcaactggacgcggggcgaacgttgcgatctggaagacagggacacgtccgagctcagcccgttactgctgaccactacacagtggcaggtcctcccgtgttccttcacaaccctaccagccttgtccaccggcctcatccacctccaccagaacattgtggacgtgcagtacttgtacggggtggggtcaagcatcgcgtcctgggccattaagtgggagtacgtcgttctcctgttccttctgcttgcagacgcgcgcgtctgctcctgcttgtggatgatgctactcatatcccaagcggaggcggctttggagaacctcgtaatacttaatgcagcatccctggccgggacgcacggtcttgtatccttcctcgtgttcttctgctttgcatggtatttgaagggtaagtgggtgcccggagcggtctacaccttctacgggatgtggcctctcctcctgctcctgttggcgttgccccagcgggcgtacgcgctggacacggaggtggccgcgtcgtgtggcggtgttgttctcgtcgggttgatggcgctgactctgtcaccatattacaagcgctatatcagctggtgcttgtggtggcttcagtattttctgaccagagtggaagcgcaactgcacgtgtggattccccccctcaacgtccgaggggggcgcgacgccgtcatcttactcatgtgtgctgtacacccgactctggtatttgacatcaccaaattgctgctggccgtcttcggacccctttggattcttcaagccagtttgcttaaagtaccctactttgtgcgcgtccaaggccttctccggttctgcgcgttagcgcggaagatgatcggaggccattacgtgcaaatggtcatcattaagttaggggcgcttactggcacctatgtttataaccatctcactcctcttcgggactgggcgcacaacggcttgcgagatctggccgtggctgtagagccagtcgtcttctcccaaatggagaccaagctcatcacgtggggggcagataccgccgcgtgcggtgacatcatcaacggcttgcctgtttccgcccgcaggggccgggagatactgctcgggccagccgatggaatggtctccaaggggtggaggttgctggcgcccatcacggcgtacgcccagcagacaaggggcctcctagggtgcataatcaccagcctaactggccgggacaaaaaccaagtggagggtgaggtccagattgtgtcaactgctgcccaaaccttcctggcaacgtgcatcaatggggtgtgctggactgtctaccacggggccggaacgaggaccatcgcgtcacccaagggtcctgtcatccagatgtataccaatgtagaccaagaccttgtgggctggcccgctccgcaaggtagccgctcattgacaccctgcacttgcggctcctcggacctttacctggtcacgaggcacgccgatgtcattcccgtgcgccggcggggtgatagcaggggcagcctgctgtcgccccggcccatttcctacttgaaaggctcctcggggggtccgctgttgtgccccgcggggcacgccgtgggcatatttagggccgcggtgtgcacccgtggagtggctaaggcggtggactttatccctgtggagaacctagagacaaccatgaggtccccggtgttcacggataactcctctccaccagtagtgccccagagcttccaggtggctcacctccatgctcccacaggcagcggcaaaagcaccaaggtcccggctgcatatgcagctcagggctataaggtgctagtactcaacccctctgttgctgcaacactgggctttggtgcttacatgtccaaggctcatgggatcgatcctaacatcaggaccggggtgagaacaattaccactggcagccccatcacgtactccacctacggcaagttccttgccgacggcgggtgctcggggggcgcttatgacataataatttgtgacgagtgccactccacggatgccacatccatcttgggcatcggcactgtccttgaccaagcagagactgcgggggcgagactggttgtgctcgccaccgccacccctccgggctccgtcactgtgccccatcccaacatcgaggaggttgctctgtccaccaccggagagatccctttttacggcaaggctatccccctcgaagtaatcaagggggggagacatctcatcttctgtcattcaaagaagaagtgcgacgaactcgccgcaaagctggtcgcattgggcatcaatgccgtggcctactaccgcggtcttgacgtgtccgtcatcccgaccagcggcgatgttgtcgtcgtggcaaccgatgccctcatgaccggctataccggcgacttcgactcggtgatagactgcaatacgtgtgtcacccagacagtcgatttcagccttgaccctaccttcaccattgagacaatcacgctcccccaggatgctgtctcccgcactcaacgtcggggcaggactggcagggggaagccaggcatctacagatttgtggcaccgggggagcgcccctccggcatgttcgactcgtccgtcctctgtgagtgctatgacgcaggctgtgcttggtatgagctcacgcccgccgagactacagttaggctacgagcgtacatgaacaccccggggcttcccgtgtgccaggaccatcttgaattttgggagggcgtctttacaggcctcactcatatagatgcccactttctatcccagacaaagcagagtggggagaaccttccttacctggtagcgtaccaagccaccgtgtgcgctagggctcaagcccctcccccatcgtgggaccagatgtggaagtgtttgattcgcctcaagcccaccctccatgggccaacacccctgctatacagactgggcgctgttcagaatgaaatcaccctgacgcacccagtcaccaaatacatcatgacatgcatgtcggccgacctggaggtcgtcacgagcacctgggtgctcgttggcggcgtcctggctgctttggccgcgtattgcctgtcaacaggctgcgtggtcatagtgggcagggtcgtcttgtccgggaagccggcaatcatacctgacagggaagtcctctaccgagagttcgatgagatggaagagtgctctcagcacttaccgtacatcgagcaagggatgatgctcgccgagcagttcaagcagaaggccctcggcctcctgcagaccgcgtcccgtcaggcagaggttatcgcccctgctgtccagaccaactggcaaaaactcgagaccttctgggcgaagcatatgtggaacttcatcagtgggatacaatacttggcgggcttgtcaacgctgcctggtaaccccgccattgcttcattgatggcttttacagctgctgtcaccagcccactaaccactagccaaaccctcctcttcaacatattgggggggtgggtggctgcccagctcgccgcccccggtgccgctactgcctttgtgggcgctggcttagctggcgccgccatcggcagtgttggactggggaaggtcctcatagacatccttgcagggtatggcgcgggcgtggcgggagctcttctggcattcaagatcatgagcggtgaggtcccctccacggaggacctggtcaatctactgcccgccatcctctcgcccggagccctcgtagtcggcgtggtctgtgcagcaatactgcgccggcacgttggcccgggcgagggggcagtgcagtggatgaaccggctgatagccttcgcctcccgggggaaccatgtttcccccacgcactacgtgccggagagcgatgcagctgcccgcgtcactgccatactcagcagcctcactgtaacccagctcctgaggcgactgcaccagtggataagctcggagtgtaccactccatgctccggttcctggctaagggacatctgggactggatatgcgaggtgttgagcgactttaagacctggctaaaagctaagctcatgccacagctgcctgggatcccctttgtgtcctgccagcgcgggtataagggggtctggcgagtggacggcatcatgcacactcgctgccactgtggagctgagatcactggacatgtcaaaaacgggacgatgaggatcgtcggtcctaggacctgcaggaacatgtggagtgggaccttccccattaatgcctacaccacgggcccctgtaccccccttcctgcgccgaactacacgttcgcgctatggagggtgtctgcagaggaatatgtggagataaggcaggtgggggacttccactacgtgacgggtatgactactgacaatctcaaatgcccgtgccaggtcccatcgcccgaatttttcacagaattggacggggtgcgcctacataggtttgcgcccccctgcaagcccttgctgcgggaggaggtatcattcagagtaggactccacgaatacccggtagggtcgcaattaccttgcgagcccgaaccggacgtggccgtgttgacgtccatgctcactgatccctcccatataacagcagaggcggccgggcgaaggttggcgaggggatcacccccctctgtggccagctcctcggctagccagctatccgctccatctctcaaggcaacttgcaccgctaaccatgactcccctgatgctgagctcatagaggccaacctcctatggaggcaggagatgggcggcaacatcaccagggttgagtcagaaaacaaagtggtgattctggactccttcgatccgcttgtggcggaggaggacgagcgggagatctccgtacccgcagaaatcctgcggaagtctcggagattcgcccaggccctgcccgtttgggcgcggccggactataaccccccgctagtggagacgtggaaaaagcccgactacgaaccacctgtggtccatggctgtccgcttccacctccaaagtcccctcctgtgcctccgcctcggaagaagcggacggtggtcctcactgaatcaaccctatctactgccttggccgagctcgccaccagaagctttggcagctcctcaacttccggcattacgggcgacaatacgacaacatcctctgagcccgccccttctggctgcccccccgactccgacgctgagtcctattcctccatgccccccctggagggggagcctggggatccggatcttagcgacgggtcatggtcaacggtcagtagtgaggccaacgcggaggatgtcgtgtgctgctcaatgtcttactcttggacaggcgcactcgtcaccccgtgcgccgcggaagaacagaaactgcccatcaatgcactaagcaactcgttgctacgtcaccacaatttggtgtattccaccacctcacgcagtgcttgccaaaggcagaagaaagtcacatttgacagactgcaagttctggacagccattaccaggacgtactcaaggaggttaaagcagcggcgtcaaaagtgaaggctaacttgctatccgtagaggaagcttgcagcctgacgcccccacactcagccaaatccaagtttggttatggggcaaaagacgtccgttgccatgccagaaaggccgtaacccacatcaactccgtgtggaaagaccttctggaagacaatgtaacaccaatagacactaccatcatggctaagaacgaggttttctgcgttcagcctgagaaggggggtcgtaagccagctcgtctcatcgtgttccccgatctgggcgtgcgcgtgtgcgaaaagatggctttgtacgacgtggttacaaagctccccttggccgtgatgggaagctcctacggattccaatactcaccaggacagcgggttgaattcctcgtgcaagcgtggaagtccaagaaaaccccaatggggttctcgtatgatacccgctgctttgactccacagtcactgagagcgacatccgtacggaggaggcaatctaccaatgttgtgacctcgacccccaagcccgcgtggccatcaagtccctcaccgagaggctttatgttgggggccctcttaccaattcaaggggggagaactgcggctatcgcaggtgccgcgcgagcggcgtactgacaactagctgtggtaacaccctcacttgctacatcaaggcccgggcagcctgtcgagccgcagggctccaggactgcaccatgctcgtgtgtggcgacgacttagtcgttatctgtgaaagcgcgggggtccaggaggacgcggcgagcctgagagccttcacggaggctatgaccaggtactccgccccccctggggaccccccacaaccagaatacgacttggagctcataacatcatgctcctccaacgtgtcagtcgcccacgacggcgctggaaagagggtctactacctcacccgtgaccctacaacccccctcgcgagagctgcgtgggagacagcaagacacactccagtcaattcctggctaggcaacataatcatgtttgcccccacactgtgggcgaggatgatactgatgacccatttctttagcgtccttatagccagggaccagcttgaacaggccctcgattgcgagatctacggggcctgctactccatagaaccacttgatctacctccaatcattcaaagactc

SEQ ID NO: 75 - protein, 2436 aa
GCPERLASCRPLTDFDQGWGPISYANGSGPDQRPYCWHYPPKPCGIVPAKSVCGPVYCFTPSPVVVGTTDRSGAPTYSWGENDTDVFVLNNTRPPLGNWFGCTWMNSTGFTKVCGAPPCVIGGAGNNTLHCPTDCFRKHPDATYSRCGSGPWITPRCLVDYPYRLWHYPCTINYTIFKIRMYVGGVEHRLEAACNWTRGERCDLEDRDTSELSPLLLTTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGKWVPGAVYTFYGMWPLLLLLLALPQRAYALDTEVAASCGGVVLVGLMALTLSPYYKRYISWCLWWLQYFLTRVEAQLHVWIPPLNVRGGRDAVILLMCAVHPTLVFDITKLLLAVFGPLWILQASLLKVPYFVRVQGLLRFCALARKMIGGHYVQMVIIKLGALTGTYVYNHLTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVENLETTMRSPVFTDNSSPPVVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGYTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEITLTHPVTKYIMTCMSADLEVVTSTWVLVGGVLAALAAYCLSTGCVVIVGRVVLSGKPAIIPDREVLYREFDEMEECSQHLPYIEQGMMLAEQFKQKALGLLQTASRQAEVIAPAVQTNWQKLETFWAKHMWNFISGIQYLAGLSTLPGNPAIASLMAFTAAVTSPLTTSQTLLFNILGGWVAAQLAAPGAATAFVGAGLAGAAIGSVGLGKVLIDILAGYGAGVAGALLAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYKGVWRVDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGGNITRVESENKVVILDSFDPLVAEEDEREISVPAEILRKSRRFAQALPVWARPDYNPPLVETWKKPDYEPPVVHGCPLPPPKSPPVPPPRKKRTVVLTESTLSTALAELATRSFGSSSTSGITGDNTTTSSEPAPSGCPPDSDAESYSSMPPLEGEPGDPDLSDGSWSTVSSEANAEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVTHINSVWKDLLEDNVTPIDTTIMAKNEVFCVQPEKGGRKPARLIVFPDLGVRVCEKMALYDVVTKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRL

SEQ ID NO: 76 - DNA (cDNA), 540 bp; single-stranded, linear
  CDS 3..539
  immediate source clone: 13i
ctcccagccccgtggtggtgggaacgaccgacaggtcgggcgcgcccacctacagctggggtgaaaatgatacggacgtcttcgtccttaacaataccaggccaccgctgggcaattggttcggttgtacctggatgaactcaactggattcaccaaagtgtgcggagcgcctccttgtgtcatcggaggggcgggcaacaacaccctgcactgccccactgattgcttccgcaagcatccggacgccacatactctcggtgcggctccggtccctggatcacacccaggtgcctggtcgactacccgtataggctttggcattatccttgtaccatcaactacaccatatttaaaatcaggatgtacgtgggaggggtcgaacacaggctggaagctgcctgcaactggacgcggggcgaacgttgcgatctggaagacagggacaggtccgagctcaccccgttactgctgaccactacacagtggcaggtcctcccgtgttccttcacaaccctaccagccttgtccaccggcctca

SEQ ID NO: 77 - protein, 179 aa
PSPVVVGTTDRSGAPTYSWGENDTDVFVLNNTRPPLGNWFGCTWMNSTGFTKVCGAPPCVIGGAGNNTLHCPTDCFRKHPDATYSRCGSGPWITPRCLVDYPYRLWHYPCTINYTIFKIRMYVGGVEHRLEAACNWTRGERCDLEDRDRSELTPLLLTTTQWQVLPCSFTTLPALSTGL

SEQ ID NO: 78 - DNA (cDNA), 231 bp; single-stranded, linear
  CDS 2..229
  immediate source clone: 26j
gcttttctatcaccacaagttcaactcttcaggctgtcctgagaggctagccagctgccgaccccttaccgattttgaccagggctggggccctatcagttatgccaacggaagcggccccgaccagcgcccctactgctggcactaccccccaaaaccttgcggtattgtgcccgcgaagagtgtgtgtggtccggtatattgcttcactcccagccccgtggtggtggg

SEQ ID NO: 79 - protein, 76 aa
LFYHHKFNSSGCPERLASCRPLTDFDQGWGPISYANGSGPDQRPYCWHYPPKPCGIVPAKSVCGPVYCFTPSPVVV

SEQ ID NO: 80 - DNA (cDNA), 391 bp; single-stranded, linear
  CDS 1..390
  immediate source clone: CA59a
ttggtaatggctcagctgctccggatcccacaagccatcttggacatgatcgctggtgctcactggggagtcctggcgggcatagcgtatttctccatggtggggaactgggcgaaggtcctggtagtgctgctgctatttgccggcgtcgacgcggaaacccacgtcaccgggggaagtgccggccacactgtgtctggatttgttagcctcctcgcaccaggcgccaagcagaacgtccagctgatcaacaccaacggcagttggcacctcaatagcacggccctgaactgcaatgatagcctcaacaccggctggttggcagggcttttctatcaccacaagttcaactcttcaggctgtcctgagaggctagccagctgccgacccc

SEQ ID NO: 81 - protein, 130 aa
LVMAQLLRIPQAILDMIAGAHWGVLAGIAYFSMVGNWAKVLVVLLLFAGVDAETHVTGGSAGHTVSGFVSLLAPGAKQNVQLINTNGSWHLNSTALNCNDSLNTGWLAGLFYHHKFNSSGCPERLASCRP

SEQ ID NO: 82 - DNA (cDNA), 267 bp; single-stranded, linear
  CDS 3..266
  immediate source clone: CA84a
cgcaaggttgcaattgctctatctatcccggccatataacgggtcaccgcatggcatgggatatgatgatgaactggtcccctacgacggcgttggtaatggctcagctgctccggatcccacaagccatcttggacatgatcgctggtgctcactggggagtcctggcgggcatagcgtatttctccatggtggggaactgggcgaaggtcctggtagtgctgctgctatttgccggcgtcgacgcggaaacccacgtcaccgggg

SEQ ID NO: 83 - protein, 88 aa
QGCNCSIYPGHITGHRMAWDMMMNWSPTTALVMAQLLRIPQAILDMIAGAHWGVLAGIAYFSMVGNWAKVLVVLLLFAGVDAETHVTG

SEQ ID NO: 84 - DNA (cDNA), 319 bp; single-stranded, linear
  CDS 2..319
  immediate source clone: CA156e
gtgttgggtggcgatgacccctacggtggccaccagggatggcaaactccccgcgacgcagcttcgacgtcacatcgatctgcttgtcgggagcgccaccctctgttcggccctctacgtgggggacctatgcgggtctgtctttcttgtcggccaactgttcaccttctctcccaggcgccactggacgacgcaaggttgcaattgctctatctatcccggccatataacgggtcaccgcatggcatgggatatgatgatgaactggtcccctacgacggcgttggtaatggctcagctgctccggatcccacaagcc

SEQ ID NO: 85 - protein, 106 aa
CWVAMTPTVATRDGKLPATQLRRHIDLLVGSATLCSALYVGDLCGSVFLVGQLFTFSPRRHWTTQGCNCSIYPGHITGHRMAWDMMMNWSPTTALVMAQLLRIPQA

SEQ ID NO: 86 - DNA (cDNA), 272 bp; single-stranded, linear
  CDS 2..271
  immediate source clone: CA167b
ctccacggggctttaccacgtcaccaatgattgccctaactcgagtattgtgtacgaggcggccgatgccatcctgcacactccggggtgcgtcccttgcgttcgtgagggcaacgcctcgaggtgttgggtggcgatgacccctacggtggccaccagggatggcaaactccccgcgacgcagcttcgacgtcacatcgatctgcttgtcgggagcgccaccctctgttcggccctctacgtgggggacctatgcgggtctgtctttcttg

SEQ ID NO: 87 - protein, 90 aa
STGLYHVTNDCPNSSIVYEAADAILHTPGCVPCVREGNASRCWVAMTPTVATRDGKLPATQLRRHIDLLVGSATLCSALYVGDLCGSVFL

SEQ ID NO: 88 - DNA (cDNA), 8316 bp; single-stranded, linear
  CDS 1..8316
aggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcttgactgtgcccgcttcggcctaccaagtgcgcaactccacggggctttaccacgtcaccaatgattgccctaactcgagtattgtgtacgaggcggccgatgccatcctgcacactccggggtgcgtcccttgcgttcgtgagggcaacgcctcgaggtgttgggtggcgatgacccctacggtggccaccagggatggcaaactccccgcgacgcagcttcgacgtcacatcgatctgcttgtcgggagcgccaccctctgttcggccctctacgtgggggacctatgcgggtctgtctttcttgtcggccaactgttcaccttctctcccaggcgccactggacgacgcaaggttgcaattgctctatctatcccggccatataacgggtcaccgcatggcatgggatatgatgatgaactggtcccctacgacggcgttggtaatggctcagctgctccggatcccacaagccatcttggacatgatcgctggtgctcactggggagtcctggcgggcatagcgtatttctccatggtggggaactgggcgaaggtcctggtagtgctgctgctatttgccggcgtcgacgcggaaacccacgtcaccgggggaagtgccggccacactgtgtctggatttgttagcctcctcgcaccaggcgccaagcagaacgtccagctgatcaacaccaacggcagttggcacctcaatagcacggccctgaactgcaatgatagcctcaacaccggctggttggcagggcttttctatcaccacaagttcaactcttcaggctgtcctgagaggctagccagctgccgaccccttaccgattttgaccagggctggggccctatcagttatgccaacggaagcggccccgaccagcgcccctactgctggcactaccccccaaaaccttgcggtattgtgcccgcgaagagtgtgtgtggtccggtatattgcttcactcccagccccgtggtggtgggaacgaccgacaggtcgggcgcgcccacctacagctggggtgaaaatgatacggacgtcttcgtccttaacaataccaggccaccgctgggcaattggttcggttgtacctggatgaactcaactggattcaccaaagtgtgcggagcgcctccttgtgtcatcggaggggcgggcaacaacaccctgcactgccccactgattgcttccgcaagcatccggacgccacatactctcggtgcggctccggtccctggatcacacccaggtgcctggtcgactacccgtataggctttggcattatccttgtaccatcaactacaccatatttaaaatcaggatgtacgtgggaggggtcgaacacaggctggaagctgcctgcaactggacgcggggcgaacgttgcgatctggaagacagggacaggtccgagctcaccccgttactgctgaccactacacagtggcaggtcctcccgtgttccttcacaaccctaccagccttgtccaccggcctcatccacctccaccagaacattgtggacgtgcagtacttgtacggggtggggtcaagcatcgcgtcctgggccattaagtgggagtacgtcgttctcctgttccttctgcttgcagacgcgcgcgtctgctcctgcttgtggatgatgctactcatatcccaagcggaggcggctttggagaacctcgtaatacttaatgcagcatccctggccgggacgcacggtcttgtatccttcctcgtgttcttctgctttgcatggtatttgaagggtaagtgggtgcccggagcggtctacaccttctacgggatgtggcctctcctcctgctcctgttggcgttgccccagcgggcgtacgcgctggacacggaggtggccgcgtcgtgtggcggtgttgttctcgtcgggttgatggcgctgactctgtcaccatattacaagcgctatatcagctggtgcttgtggtggcttcagtattttctgaccagagtggaagcgcaactgcacgtgtggattccccccctcaacgtccgaggggggcgcgacgccgtcatcttactcatgtgtgctgtacacccgactctggtatttgacatcaccaaattgctgctggccgtcttcggacccctttggattcttcaagccagtttgcttaaagtaccctactttgtgcgcgtccaaggccttctccggttctgcgcgttagcgcggaagatgatcggaggccattacgtgcaaatggtcatcattaagttaggggcgcttactggcacctatgtttataaccatctcactcctcttcgggactgggcgcacaacggcttgcgagatctggccgtggctgtagagccagtcgtcttctcccaaatggagaccaagctcatcacgtggggggcagataccgccgcgtgcggtgacatcatcaacggcttgcctgtttccgcccgcaggggccgggagatactgctcgggccagccgatggaatggtctccaaggggtggaggttgctggcgcccatcacggcgtacgcccagcagacaaggggcctcctagggtgcataatcaccagcctaactggccgggacaaaaaccaagtggagggtgaggtccagattgtgtcaactgctgcccaaaccttcctggcaacgtgcatcaatggggtgtgctggactgtctaccacggggccggaacgaggaccatcgcgtcacccaagggtcctgtcatccagatgtataccaatgtagaccaagaccttgtgggctggcccgctccgcaaggtagccgctcattgacaccctgcacttgcggctcctcggacctttacctggtcacgaggcacgccgatgtcattcccgtgcgccggcggggtgatagcaggggcagcctgctgtcgccccggcccatttcctacttgaaaggctcctcggggggtccgctgttgtgccccgcggggcacgccgtgggcatatttagggccgcggtgtgcacccgtggagtggctaaggcggtggactttatccctgtggagaacctagagacaaccatgaggtccccggtgttcacggataactcctctccaccagtagtgccccagagcttccaggtggctcacctccatgctcccacaggcagcggcaaaagcaccaaggtcccggctgcatatgcagctcagggctataaggtgctagtactcaacccctctgttgctgcaacactgggctttggtgcttacatgtccaaggctcatgggatcgatcctaacatcaggaccggggtgagaacaattaccactggcagccccatcacgtactccacctacggcaagttccttgccgacggcgggtgctcggggggcggttatgacataataatttgtgacgagtgccactccacggatgccacatccatcttgggcatcggcactgtccttgaccaagcagagactgcgggggcgagactggttgtgctcgccaccgccacccctccgggctccgtcactgtgccccatcccaacatcgaggaggttgctctgtccaccaccggagagatccctttttacggcaaggctatccccctcgaagtaatcaagggggggagacatctcatcttctgtcattcaaagaagaagtgcgacgaactcgccgcaaagctggtcgcattgggcatcaatgccgtggcctactaccgcggtcttgacgtgtccgtcatcccgaccagcggcgatgttgtcgtcgtggcaaccgatgccctcatgaccggctataccggcgacttcgactcggtgatagactgcaatacgtgtgtcacccagacagtcgatttcagccttgaccctaccttcaccattgagacaatcacgctcccccaggatgctgtctcccgcactcaacgtcggggcaggactggcagggggaagccaggcatctacagatttgtggcaccgggggagcgcccctccggcatgttcgactcgtccgtcctctgtgagtgctatgacgcaggctgtgcttggtatgagctcacgcccgccgagactacagttaggctacgagcgtacatgaacaccccggggcttcccgtgtgccaggaccatcttgaattttgggagggcgtctttacaggcctcactcatatagatgcccactttctatcccagacaaagcagagtggggagaaccttccttacctggtagcgtaccaagccaccgtgtgcgctagggctcaagcccctcccccatcgtgggaccagatgtggaagtgtttgattcgcctcaagcccaccctccatgggccaacacccctgctatacagactgggcgctgttcagaatgaaatcaccctgacgcacccagtcaccaaatacatcatgacatgcatgtcggccgacctggaggtcgtcacgagcacctgggtgctcgttggcggcgtcctggctgctttggccgcgtattgcctgtcaacaggctgcgtggtcatagtgggcagggtcgtcttgtccgggaagccggcaatcatacctgacagggaagtcctctaccgagagttcgatgagatggaagagtgctctcagcacttaccgtacatcgagcaagggatgatgctcgccgagcagttcaagcagaaggccctcggcctcctgcagaccgcgtcccgtcaggcagaggttatcgcccctgctgtccagaccaactggcaaaaactcgagaccttctgggcgaagcatatgtggaacttcatcagtgggatacaatacttggcgggcttgtcaacgctgcctggtaaccccgccattgcttcattgatggcttttacagctgctgtcaccagcccactaaccactagccaaaccctcctcttcaacatattgggggggtgggtggctgcccagctcgccgcccccggtgccgctactgcctttgtgggcgctggcttagctggcgccgccatcggcagtgttggactggggaaggtcctcatagacatccttgcagggtatggcgcgggcgtggcgggagctcttgtggcattcaagatcatgagcggtgaggtcccctccacggaggacctggtcaatctactgcccgccatcctctcgcccggagccctcgtagtcggcgtggtctgtgcagcaatactgcgccggcacgttggcccgggcgagggggcagtgcagtggatgaaccggctgatagccttcgcctcccgggggaaccatgtttcccccacgcactacgtgccggagagcgatgcagctgcccgcgtcactgccatactcagcagcctcactgtaacccagctcctgaggcgactgcaccagtggataagctcggagtgtaccactccatgctccggttcctggctaagggacatctgggactggatatgcgaggtgttgagcgactttaagacctggctaaaagctaagctcatgccacagctgcctgggatcccctttgtgtcctgccagcgcgggtataagggggtctggcgagtggacggcatcatgcacactcgctgccactgtggagctgagatcactggacatgtcaaaaacgggacgatgaggatcgtcggtcctaggacctgcaggaacatgtggagtgggaccttccccattaatgcctacaccacgggcccctgtaccccccttcctgcgccgaactacacgttcgcgctatggagggtgtctgcagaggaatatgtggagataaggcaggtgggggacttccactacgtgacgggtatgactactgacaatctcaaatgcccgtgccaggtcccatcgcccgaatttttcacagaattggacggggtgcgcctacataggtttgcgcccccctgcaagcccttgctgcgggaggaggtatcattcagagtaggactccacgaatacccggtagggtcgcaattaccttgcgagcccgaaccggacgtggccgtgttgacgtccatgctcactgatccctcccatataacagcagaggcggccgggcgaaggttggcgaggggatcacccccctctgtggccagctcctcggctagccagctatccgctccatctctcaaggcaacttgcaccgctaaccatgactcccctgatgctgagctcatagaggccaacctcctatggaggcaggagatgggcggcaacatcaccagggttgagtcagaaaacaaagtggtgattctggactccttcgatccgcttgtggcggaggaggacgagcgggagatctccgtacccgcagaaatcctgcggaagtctcggagattcgcccaggccctgcccgtttgggcgcggccggactataaccccccgctagtggagacgtggaaaaagcccgactacgaaccacctgtggtccatggctgtccgcttccacctccaaagtcccctcctgtgcctccgcctcggaagaagcggacggtggtcctcactgaatcaaccctatctactgccttggccgagctcgccaccagaagctttggcagctcctcaacttccggcattacgggcgacaatacgacaacatcctctgagcccgccccttctggctgcccccccgactccgacgctgagtcctattcctccatgccccccctggagggggagcctggggatccggatcttagcgacgggtcatggtcaacggtcagtagtgaggccaacgcggaggatgtcgtgtgctgctcaatgtcttactcttggacaggcgcactcgtcaccccgtgcgccgcggaagaacagaaactgcccatcaatgcactaagcaactcgttgctacgtcaccacaatttggtgtattccaccacctcacgcagtgcttgccaaaggcagaagaaagtcacatttgacagactgcaagttctggacagccattaccaggacgtactcaaggaggttaaagcagcggcgtcaaaagtgaaggctaacttgctatccgtagaggaagcttgcagcctgacgcccccacactcagccaaatccaagtttggttatggggcaaaagacgtccgttgccatgccagaaaggccgtaacccacatcaactccgtgtggaaagaccttctggaagacaatgtaacaccaatagacactaccatcatggctaagaacgaggttttctgcgttcagcctgagaaggggggtcgtaagccagctcgtctcatcgtgttccccgatctgggcgtgcgcgtgtgcgaaaagatggctttgtacgacgtggttacaaagctccccttggccgtgatgggaagctcctacggattccaatactcaccaggacagcgggttgaattcctcgtgcaagcgtggaagtccaagaaaaccccaatggggttctcgtatgatacccgctgctttgactccacagtcactgagagcgacatccgtacggaggaggcaatctaccaatgttgtgacctcgacccccaagcccgcgtggccatcaagtccctcaccgagaggctttatgttgggggccctcttaccaattcaaggggggagaactgcggctatcgcaggtgccgcgcgagcggcgtactgacaactagctgtggtaacaccctcacttgctacatcaaggcccgggcagcctgtcgagccgcagggctccaggactgcaccatgctcgtgtgtggcgacgacttagtcgttatctgtgaaagcgcgggggtccaggaggacgcggcgagcctgagagccttcacggaggctatgaccaggtactccgccccccctggggaccccccacaaccagaatacgacttggagctcataacatcatgctcctccaacgtgtcagtcgcccacgacggcgctggaaagagggtctactacctcacccgtgaccctacaacccccctcgcgagagctgcgtgggagacagcaagacacactccagtcaattcctggctaggcaacataatcatgtttgcccccacactgtgggcgaggatgatactgatgacccatttctttagcgtccttatagccagggaccagcttgaacaggccctcgattgcgagatctacggggcctgctactccatagaaccacttgatctacctccaatcattcaaagactc

SEQ ID NO: 89 - protein, 2772 aa
RSRNLGKVIDTLTCGFADLMGYIPLVGAPLGGAARALAHGVRVLEDGVNYATGNLPGCSFSIFLLALLSCLTVPASAYQVRNSTGLYHVTNDCPNSSIVYEAADAILHTPGCVPCVREGNASRCWVAMTPTVATRDGKLPATQLRRHIDLLVGSATLCSALYVGDLCGSVFLVGQLFTFSPRRHWTTQGCNCSIYPGHITGHRMAWDMMMNWSPTTALVMAQLLRIPQAILDMIAGAHWGVLAGIAYFSMVGNWAKVLVVLLLFAGVDAETHVTGGSAGHTVSGFVSLLAPGAKQNVQLINTNGSWHLNSTALNCNDSLNTGWLAGLFYHHKFNSSGCPERLASCRPLTDFDQGWGPISYANGSGPDQRPYCWHYPPKPCGIVPAKSVCGPVYCFTPSPVVVGTTDRSGAPTYSWGENDTDVFVLNNTRPPLGNWFGCTWMNSTGFTKVCGAPPCVIGGAGNNTLHCPTDCFRKHPDATYSRCGSGPWITPRCLVDYPYRLWHYPCTINYTIFKIRMYVGGVEHRLEAACNWTRGERCDLEDRDRSELTPLLLTTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGKWVPGAVYTFYGMWPLLLLLLALPQRAYALDTEVAASCGGVVLVGLMALTLSPYYKRYISWCLWWLQYFLTRVEAQLHVWIPPLNVRGGRDAVILLMCAVHPTLVFDITKLLLAVFGPLWILQASLLKVPYFVRVQGLLRFCALARKMIGGHYVQMVIIKLGALTGTYVYNHLTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVENLETTMRSPVFTDNSSPPVVPQSFQVAHLHAPTGSGKSTKVPAAYAAQGYKVLVLNPSVAATLGFGAYMSKAHGIDPNIRTGVRTITTGSPITYSTYGKFLADGGCSGGGYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGYTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEITLTHPVTKYIMTCMSADLEVVTSTWVLVGGVLAALAAYCLSTGCVVIVGRVVLSGKPAIIPDREVLYREFDEMEECSQHLPYIEQGMMLAEQFKQKALGLLQTASRQAEVIAPAVQTNWQKLETFWAKHMWNFISGIQYLAGLSTLPGNPAIASLMAFTAAVTSPLTTSQTLLFNILGGWVAAQLAAPGAATAFVGAGLAGAAIGSVGLGKVLIDILAGYGAGVAGALVAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYKGVWRVDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGGNITRVESENKVVILDSFDPLVAEEDEREISVPAEILRKSRRFAQALPVWARPDYNPPLVETWKKPDYEPPVVHGCPLPPPKSPPVPPPRKKRTVVLTESTLSTALAELATRSFGSSSTSGITGDNTTTSSEPAPSGCPPDSDAESYSSMPPLEGEPGDPDLSDGSWSTVSSEANAEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVTHINSVWKDLLEDNVTPIDTTIMAKNEVFCVQPEKGGRKPARLIVFPDLGVRVCEKMALYDVVTKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRL

SEQ ID NO: 90 - DNA (cDNA), 407 bp; single-stranded, linear
  CDS 3..407
  immediate source clone: CA216a
cccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcttgactgtgcccgcttcggcctaccaagtgcgcaactccacggggctttaccacgtcaccaatgattgccctaactcgagtattgtgtacgaggcggccgatgccatcctgcacactccggggtgcgtcccttgcgttcgtgagggcaacgcctcgaggtgttgggtggcgatgacccctacggtggcc

SEQ ID NO: 91 - protein, 135 aa
RRRSRNLGKVIDTLTCGFADLMGYIPLVGAPLGGAARALAHGVRVLEDGVNYATGNLPGCSFSIFLLALLSCLTVPASAYQVRNSTGLYHVTNDCPNSSIVYEAADAILHTPGCVPCVREGNASRCWVAMTPTVA

SEQ ID NO: 92 - DNA (cDNA), 509 bp; single-stranded, linear
  CDS 3..509
  immediate source clone: CA290a
aaaaaaaaaacaaacgtaacaccaaccgtcgcccacaggacgtcaagttcccgggtggcggtcagatcgttggtggagtttacttgttgccgcgcaggggccctagattgggtgtgcgcgcgacgagaaagacttccgagcggtcgcaacctcgaggtagacgtcagcctatccccaaggctcgtcggcccgagggcaggacctgggctcagcccgggtacccttggcccctctatggcaatgagggctgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctaccttc

SEQ ID NO: 93 - protein, 169 aa
KKNKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSTF

SEQ ID NO: 94 - DNA (cDNA), 665 bp; single-stranded, linear
  immediate source clone: ag30a
cgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaaaaaaaaacaaacgtaacaccaaccgtcgcccacaggacgtcaagttcccgggtggcggtcagatcgttggtggagtttacttgttgccgcgcaggggccctagattgggtgtgcgcgcgacgagaaagacttccgagcggtcgcaacctcgaggtagacgtcagcctatccccaaggctcgtcggcccgagggcaggacctgggctcagcccgggtacccttggcccctctatggcaatgagggctgcgggtgggcgggatggctcctgtctccccgtggctctcggcctagctggggccccacagacccccggcgtaggtcgcgcaatttgggtaaggtcatcgatacccttacgtgcggcttc

SEQ ID NO: 95 - DNA (cDNA), 665 bp; single-stranded, linear
  anti-sense: YES
  immediate source clone: ag30a
gaagccgcacgtaagggtatcgatgaccttacccaaattgcgcgacctacgccgggggtctgtggggccccagctaggccgagagccacggggagacaggagccatcccgcccacccgcagccctcattgccatagaggggccaagggtacccgggctgagcccaggtcctgccctcgggccgacgagccttggggataggctgacgtctacctcgaggttgcgaccgctcggaagtctttctcgtcgcgcgcacacccaatctagggcccctgcgcggcaacaagtaaactccaccaacgatctgaccgccacccgggaacttgacgtcctgtgggcgacggttggtgttacgtttgttttttttttgaggtttaggattcgtgctcatggtgcacggtctacgagacctcccggggcactcgcaagcaccctatcaggcagtaccacaaggcctttcgcgacccaacactactcggctagcagtcttgcgggggcacgcccaaatctccaggcattgagcgggttgatccaagaaaggacccggtcgtcctggcaattccggtgtactcaccggttccgcagaccactatggctctcccgggagggggggtcctggaggctgcacgacactcatactaacgccatggctagacgctttctgcg

SEQ ID NO: 96 - DNA (cDNA), 665 bp; single-stranded, linear; identical to SEQ ID NO: 94
  CDS 19..30
  immediate source clone: ag30a

SEQ ID NO: 97 - protein, 4 aa
MALV

SEQ ID NO: 98 - DNA (cDNA), 665 bp; single-stranded, linear; identical to SEQ ID NO: 94
  CDS 30..74
  immediate source clone: ag30a

SEQ ID NO: 99 - protein, 15 aa
MSVVQPPGPPLPGEP

SEQ ID NO: 100 - DNA (cDNA), 665 bp; single-stranded, linear; identical to SEQ ID NO: 94
  CDS 149..184
  immediate source clone: ag30a

SEQ ID NO: 101 - protein, 12 aa
MPGDLGVPPQDC

SEQ ID NO: 102 - DNA (cDNA), 665 bp; single-stranded, linear; identical to SEQ ID NO: 94
  CDS 234..665
  immediate source clone: ag30a

SEQ ID NO: 103 - protein, 144 aa
GACECPGRSRRPCTMSTNPKPQKKNKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGF

SEQ ID NO: 104 - DNA (cDNA), 355 bp; single-stranded, linear
  CDS 1..33
  immediate source clone: CA205a
gtcttgggtcgcgaaaggccttgtggtactgcctgatagggtgcttgcgagtgccccgggaggtctcgtagaccgtgcaccatgagcacgaatcctaaacctcaaaaaaaaaacaaacgtaacaccaaccgtcgcccacaggacgtcaagttcccgggtggcggtcagatcgttggtggagtttacttgttgccgcgcaggggccctagattgggtgtgcgcgcgacgagaaagacttccgagcggtcgcaacctcgaggtagacgtcagcctatccccaaggctcgtcggcccgagggcaggacctgggctcagcccgggtacccttggcccctctatggcaatgagggctgcg

SEQ ID NO: 105 - protein, 11 aa
VLGRERPCGTA

SEQ ID NO: 106 - DNA (cDNA), 355 bp; single-stranded, linear; identical to SEQ ID NO: 104
  CDS 40..354
  immediate source clone: CA205a

SEQ ID NO: 107 - protein, 105 aa
GACECPGRSRRPCTMSTNPKPQKKNKRNTNRRPQDVKFPGGGQIVGGVYLLPRRGPRLGVRATRKTSERSQPRGRRQPIPKARRPEGRTWAQPGYPWPLYGNEGC

SEQ ID NO: 108 - DNA (cDNA), 308 bp; single-stranded, linear
  immediate source clone: 18g
ctccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtaga

SEQ ID NO: 109 - DNA (cDNA), 308 bp; single-stranded, linear
  anti-sense: YES
  immediate source clone: 18g
tctacgagacctcccggggcactcgcaagcaccctatcaggcagtaccacaaggcctttcgcgacccaacactactcggctagcagtcttgcgggggcacgcccaaatctccaggcattgagcgggttgatccaagaaaggacccggtcgtcctggcaattccggtgtactcaccggttccgcagaccactatggctctcccgggagggggggtcctggaggctgcacgacactcatactaacgccatggctagacgctttctgcgtgaagacagtagttcctcacaggggagtgattcatggtggag

SEQ ID NO: 110 - DNA (cDNA), 308 bp; single-stranded, linear; identical to SEQ ID NO: 108
  CDS 1..72
  immediate source clone: 18g

SEQ ID NO: 111 - protein, 24 aa
LHHESLPCEELLSSRRKRLAMALV

SEQ ID NO: 112 - DNA (cDNA), 308 bp; single-stranded, linear; identical to SEQ ID NO: 108
  CDS 2..55
  immediate source clone: 18g

SEQ ID NO: 113 - protein, 18 aa
STMNHSPVRNYCLHAESV

SEQ ID NO: 114 - DNA (cDNA), 308 bp; single-stranded, linear; identical to SEQ ID NO: 108
  CDS 72..116
  immediate source clone: 18g

SEQ ID NO: 115 - protein, 15 aa
MSVVQPPGPPLPGEP

SEQ ID NO: 116 - DNA (cDNA), 308 bp; single-stranded, linear; identical to SEQ ID NO: 108
  CDS 191..226
  immediate source clone: 18g

SEQ ID NO: 117 - protein, 12 aa
MPGDLGVPPQDC

SEQ ID NO: 118 - DNA (cDNA), 308 bp; single-stranded, linear; identical to SEQ ID NO: 108
  CDS 276..308
  immediate source clone: 18g

SEQ ID NO: 119 - protein, 11 aa
GACECPGRSRR

SEQ ID NO: 120 - DNA (cDNA), 262 bp; single-stranded, linear
  CDS 1..261: /codon= (seq: "rga", aa: OTR) /note= "There exists a heterogeneity at nucleotide 157 "R" which is either A or G and corresponding amino acid residue 53 "Xaa" is either Arg or Gly"
  immediate source clone: 16jh
ggggcctgctactccatagaaccacttgatctacctccaatcattcaaagactccatggcctcagcgcattttcactccacagttactctccaggtgaaattaatagggtggccgcatgcctcagaaaacttggggtaccgcccttgcgagcttggrgacaccgggcccggagcgtccgcgctaggcttctggccagaggaggcagggctgccatatgtggcaagtacctcttcaactgggcagtaagaacaaagctcaaac

SEQ ID NO: 121 - protein, 87 aa
GACYSIEPLDLPPIIQRLHGLSAFSLHSYSPGEINRVAACLRKLGVPPLRAWXHRARSVRARLLARGGRAAICGKYLFNWAVRTKLK

SEQ ID NO: 122 - DNA (cDNA), 9185 bp; single-stranded, linear
cactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaaaaaaaaacaaacgtaacaccaaccgtcgcccacaggacgtcaagttcccgggtggcggtcagatcgttggtggagtttacttgttgccgcgcaggggccctagattgggtgtgcgcgcgacgagaaagacttccgagcggtcgcaacctcgaggtagacgtcagcctatccccaaggctcgtcggcccgagggcaggacctgggctcagcccgggtacccttggcccctctatggcaatgagggctgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcttgactgtgcccgcttcggcctaccaagtgcgcaactccacggggctttaccacgtcaccaatgattgccctaactcgagtattgtgtacgaggcggccgatgccatcctgcacactccggggtgcgtcccttgcgttcgtgagggcaacgcctcgaggtgttgggtggcgatgacccctacggtggccaccagggatggcaaactccccgcgacgcagcttcgacgtcacatcgatctgcttgtcgggagcgccaccctctgttcggccctctacgtgggggacctatgcgggtctgtctttcttgtcggccaactgttcaccttctctcccaggcgccactggacgacgcaaggttgcaattgctctatctatcccggccatataacgggtcaccgcatggcatgggatatgatgatgaactggtcccctacgacggcgttggtaatggctcagctgctccggatcccacaagccatcttggacatgatcgctggtgctcactggggagtcctggcgggcatagcgtatttctccatggtggggaactgggcgaaggtcctggtagtgctgctgctatttgccggcgtcgacgcggaaacccacgtcaccgggggaagtgccggccacactgtgtctggatttgttagcctcctcgcaccaggcgccaagcagaacgtccagctgatcaacaccaacggcagttggcacctcaatagcacggccctgaactgcaatgatagcctcaacaccggctggttggcagggcttttctatcaccacaagttcaactcttcaggctgtcctgagaggctagccagctgccgaccccttaccgattttgaccagggctggggccctatcagttatgccaacggaagcggccccgaccagcgcccctactgctggcactaccccccaaaaccttgcggtattgtgcccgcgaagagtgtgtgtggtccggtatattgcttcactcccagccccgtggtggtgggaacgaccgacaggtcgggcgcgcccacctacagctggggtgaaaatgatacggacgtcttcgtccttaacaataccaggccaccgctgggcaattggttcggttgtacctggatgaactcaactggattcaccaaagtgtgcggagcgcctccttgtgtcatcggaggggcgggcaacaacaccctgcactgccccactgattgcttccgcaagcatccggacgccacatactctcggtgcggctccggtccctggatcacacccaggtgcctggtcgactacccgtataggctttggcattatccttgtaccatcaactacaccatatttaaaatcaggatgtacgtgggaggggtcgaacacaggctggaagctgcctgcaactggacgcggggcgaacgttgcgatctggaagacagggacaggtccgagctcaccccgttactgctgaccactacacagtggcaggtcctcccgtgttccttcacaaccctaccagccttgtccaccggcctcatccacctccaccagaacattgtggacgtgcagtacttgtacggggtggggtcaagcatcgcgtcctgggccattaagtgggagtacgtcgttctcctgttccttctgcttgcagacgcgcgcgtctgctcctgcttgtggatgatgctactcatatcccaagcggaggcggctttggagaacctcgtaatacttaatgcagcatccctggccgggacgcacggtcttgtatccttcctcgtgttcttctgctttgcatggtatttgaagggtaagtgggtgcccggagcggtctacaccttctacgggatgtggcctctcctcctgctcctgttggcgttgccccagcgggcgtacgcgctggacacggaggtggccgcgtcgtgtggcggtgttgttctcgtcgggttgatggcgctgactctgtcaccatattacaagcgctatatcagctggtgcttgtggtggcttcagtattttctgaccagagtggaagcgcaactgcacgtgtggattccccccctcaacgtccgaggggggcgcgacgccgtcatcttactcatgtgtgctgtacacccgactctggtatttgacatcaccaaattgctgctggccgtcttcggacccctttggattcttcaagccagtttgcttaaagtaccctactttgtgcgcgtccaaggccttctccggttctgcgcgttagcgcggaagatgatcggaggccattacgtgcaaatggtcatcattaagttaggggcgcttactggcacctatgtttataaccatctcactcctcttcgggactgggcgcacaacggcttgcgagatctggccgtggctgtagagccagtcgtcttctcccaaatggagaccaagctcatcacgtggggggcagataccgccgcgtgcggtgacatcatcaacggcttgcctgtttccgcccgcaggggccgggagatactgctcgggccagccgatggaatggtctccaaggggtggaggttgctggcgcccatcacggcgtacgcccagcagacaaggggcctcctagggtgcataatcaccagcctaactggccgggacaaaaaccaagtggagggtgaggtccagattgtgtcaactgctgcccaaaccttcctggcaacgtgcatcaatggggtgtgctggactgtctaccacggggccggaacgaggaccatcgcgtcacccaagggtcctgtcatccagatgtataccaatgtagaccaagaccttgtgggctggcccgctccgcaaggtagccgctcattgacaccctgcacttgcggctcctcggacctttacctggtcacgaggcacgccgatgtcattcccgtgcgccggcggggtgatagcaggggcagcctgctgtcgccccggcccatttcctacttgaaaggctcctcggggggtccgctgttgtgccccgcggggcacgccgtgggcatatttagggccgcggtgtgcacccgtggagtggctaaggcggtggactttatccctgtggagaacctagagacaaccatgaggtccccggtgttcacggataactcctctccaccagtagtgccccagagcttccaggtggctcacctccatgctcccacaggcagcggcaaaagcaccaaggtcccggctgcatatgcagctcagggctataaggtgctagtactcaacccctctgttgctgcaacactgggctttggtgcttacatgtccaaggctcatgggatcgatcctaacatcaggaccggggtgagaacaattaccactggcagccccatcacgtactccacctacggcaagttccttgccgacggcgggtgctcggggggcggttatgacataataatttgtgacgagtgccactccacggatgccacatccatcttgggcatcggcactgtccttgaccaagcagagactgcgggggcgagactggttgtgctcgccaccgccacccctccgggctccgtcactgtgccccatcccaacatcgaggaggttgctctgtccaccaccggagagatccctttttacggcaaggctatccccctcgaagtaatcaagggggggagacatctcatcttctgtcattcaaagaagaagtgcgacgaactcgccgcaaagctggtcgcattgggcatcaatgccgtggcctactaccgcggtcttgacgtgtccgtcatcccgaccagcggcgatgttgtcgtcgtggcaaccgatgccctcatgaccggctataccggcgacttcgactcggtgatagactgcaatacgtgtgtcacccagacagtcgatttcagccttgaccctaccttcaccattgagacaatcacgctcccccaggatgctgtctcccgcactcaacgtcggggcaggactggcagggggaagccaggcatctacagatttgtggcaccgggggagcgcccctccggcatgttcgactcgtccgtcctctgtgagtgctatgacgcaggctgtgcttggtatgagctcacgcccgccgagactacagttaggctacgagcgtacatgaacaccccggggcttcccgtgtgccaggaccatcttgaattttgggagggcgtctttacaggcctcactcatatagatgcccactttctatcccagacaaagcagagtggggagaaccttccttacctggtagcgtaccaagccaccgtgtgcgctagggctcaagcccctcccccatcgtgggaccagatgtggaagtgtttgattcgcctcaagcccaccctccatgggccaacacccctgctatacagactgggcgctgttcagaatgaaatcaccctgacgcacccagtcaccaaatacatcatgacatgcatgtcggccgacctggaggtcgtcacgagcacctgggtgctcgttggcggcgtcctggctgctttggccgcgtattgcctgtcaacaggctgcgtggtcatagtgggcagggtcgtcttgtccgggaagccggcaatcatacctgacagggaagtcctctaccgagagttcgatgagatggaagagtgctctcagcacttaccgtacatcgagcaagggatgatgctcgccgagcagttcaagcagaaggccctcggcctcctgcagaccgcgtcccgtcaggcagaggttatcgcccctgctgtccagaccaactggcaaaaactcgagaccttctgggcgaagcatatgtggaacttcatcagtgggatacaatacttggcgggcttgtcaacgctgcctggtaaccccgccattgcttcattgatggcttttacagctgctgtcaccagcccactaaccactagccaaaccctcctcttcaacatattgggggggtgggtggctgcccagctcgccgcccccggtgccgctactgcctttgtgggcgctggcttagctggcgccgccatcggcagtgttggactggggaaggtcctcatagacatccttgcagggtatggcgcgggcgtggcgggagctcttgtggcattcaagatcatgagcggtgaggtcccctccacggaggacctggtcaatctactgcccgccatcctctcgcccggagccctcgtagtcggcgtggtctgtgcagcaatactgcgccggcacgttggcccgggcgagggggcagtgcagtggatgaaccggctgatagccttcgcctcccgggggaaccatgtttcccccacgcactacgtgccggagagcgatgcagctgcccgcgtcactgccatactcagcagcctcactgtaacccagctcctgaggcgactgcaccagtggataagctcggagtgtaccactccatgctccggttcctggctaagggacatctgggactggatatgcgaggtgttgagcgactttaagacctggctaaaagctaagctcatgccacagctgcctgggatcccctttgtgtcctgccagcgcgggtataagggggtctggcgagtggacggcatcatgcacactcgctgccactgtggagctgagatcactggacatgtcaaaaacgggacgatgaggatcgtcggtcctaggacctgcaggaacatgtggagtgggaccttccccattaatgcctacaccacgggcccctgtaccccccttcctgcgccgaactacacgttcgcgctatggagggtgtctgcagaggaatatgtggagataaggcaggtgggggacttccactacgtgacgggtatgactactgacaatctcaaatgcccgtgccaggtcccatcgcccgaatttttcacagaattggacggggtgcgcctacataggtttgcgcccccctgcaagcccttgctgcgggaggaggtatcattcagagtaggactccacgaatacccggtagggtcgcaattaccttgcgagcccgaaccggacgtggccgtgttgacgtccatgctcactgatccctcccatataacagcagaggcggccgggcgaaggttggcgaggggatcacccccctctgtggccagctcctcggctagccagctatccgctccatctctcaaggcaacttgcaccgctaaccatgactcccctgatgctgagctcatagaggccaacctcctatggaggcaggagatgggcggcaacatcaccagggttgagtcagaaaacaaagtggtgattctggactccttcgatccgcttgtggcggaggaggacgagcgggagatctccgtacccgcagaaatcctgcggaagtctcggagattcgcccaggccctgcccgtttgggcgcggccggactataaccccccgctagtggagacgtggaaaaagcccgactacgaaccacctgtggtccatggctgtccgcttccacctccaaagtcccctcctgtgcctccgcctcggaagaagcggacggtggtcctcactgaatcaaccctatctactgccttggccgagctcgccaccagaagctttggcagctcctcaacttccggcattacgggcgacaatacgacaacatcctctgagcccgccccttctggctgcccccccgactccgacgctgagtcctattcctccatgccccccctggagggggagcctggggatccggatcttagcgacgggtcatggtcaacggtcagtagtgaggccaacgcggaggatgtcgtgtgctgctcaatgtcttactcttggacaggcgcactcgtcaccccgtgcgccgcggaagaacagaaactgcccatcaatgcactaagcaactcgttgctacgtcaccacaatttggtgtattccaccacctcacgcagtgcttgccaaaggcagaagaaagtcacatttgacagactgcaagttctggacagccattaccaggacgtactcaaggaggttaaagcagcggcgtcaaaagtgaaggctaacttgctatccgtagaggaagcttgcagcctgacgcccccacactcagccaaatccaagtttggttatggggcaaaagacgtccgttgccatgccagaaaggccgtaacccacatcaactccgtgtggaaagaccttctggaagacaatgtaacaccaatagacactaccatcatggctaagaacgaggttttctgcgttcagcctgagaaggggggtcgtaagccagctcgtctcatcgtgttccccgatctgggcgtgcgcgtgtgcgaaaagatggctttgtacgacgtggttacaaagctccccttggccgtgatgggaagctcctacggattccaatactcaccaggacagcgggttgaattcctcgtgcaagcgtggaagtccaagaaaaccccaatggggttctcgtatgatacccgctgctttgactccacagtcactgagagcgacatccgtacggaggaggcaatctaccaatgttgtgacctcgacccccaagcccgcgtggccatcaagtccctcaccgagaggctttatgttgggggccctcttaccaattcaaggggggagaactgcggctatcgcaggtgccgcgcgagcggcgtactgacaactagctgtggtaacaccctcacttgctacatcaaggcccgggcagcctgtcgagccgcagggctccaggactgcaccatgctcgtgtgtggcgacgacttagtcgttatctgtgaaagcgcgggggtccaggaggacgcggcgagcctgagagccttcacggaggctatgaccaggtactccgccccccctggggaccccccacaaccagaatacgacttggagctcataacatcatgctcctccaacgtgtcagtcgcccacgacggcgctggaaagagggtctactacctcacccgtgaccctacaacccccctcgcgagagctgcgtgggagacagcaagacacactccagtcaattcctggctaggcaacataatcatgtttgcccccacactgtgggcgaggatgatactgatgacccatttctttagcgtccttatagccagggaccagcttgaacaggccctcgattgcgagatctacggggcctgctactccatagaaccacttgatctacctccaatcattcaaagactccatggcctcagcgcattttcactccacagttactctccaggtgaaattaatagggtggccgcatgcctcagaaaacttggggtaccgcccttgcgagcttggagacaccgggcccggagcgtccgcgctaggcttctggccagaggaggcagggctgccatatgtggcaagtacctcttcaactgggcagtaagaacaaagctcaaac

SEQ ID NO: 123 - DNA (cDNA), 9185 bp; single-stranded, linear
  anti-sense: YES
gtttgagctttgttcttactgcccagttgaagaggtacttgccacatatggcagccctgcctcctctggccagaagcctagcgcggacgctccgggcccggtgtctccaagctcgcaagggcggtaccccaagttttctgaggcatgcggccaccctattaatttcacctggagagtaactgtggagtgaaaatgcgctgaggccatggagtctttgaatgattggaggtagatcaagtggttctatggagtagcaggccccgtagatctcgcaatcgagggcctgttcaagctggtccctggctataaggacgctaaagaaatgggtcatcagtatcatcctcgcccacagtgtgggggcaaacatgattatgttgcctagccaggaattgactggagtgtgtcttgctgtctcccacgcagctctcgcgaggggggttgtagggtcacgggtgaggtagtagaccctctttccagcgccgtcgtgggcgactgacacgttggaggagcatgatgttatgagctccaagtcgtattctggttgtggggggtccccagggggggcggagtacctggtcatagcctccgtgaaggctctcaggctcgccgcgtcctcctggacccccgcgctttcacagataacgactaagtcgtcgccacacacgagcatggtgcagtcctggagccctgcggctcgacaggctgcccgggccttgatgtagcaagtgagggtgttaccacagctagttgtcagtacgccgctcgcgcggcacctgcgatagccgcagttctccccccttgaattggtaagagggcccccaacataaagcctctcggtgagggacttgatggccacgcgggcttgggggtcgaggtcacaacattggtagattgcctcctccgtacggatgtcgctctcagtgactgtggagtcaaagcagcgggtatcatacgagaaccccattggggttttcttggacttccacgcttgcacgaggaattcaacccgctgtcctggtgagtattggaatccgtaggagcttcccatcacggccaaggggagctttgtaaccacgtcgtacaaagccatcttttcgcacacgcgcacgcccagatcggggaacacgatgagacgagctggcttacgaccccccttctcaggctgaacgcagaaaacctcgttcttagccatgatggtagtgtctattggtgttacattgtcttccagaaggtctttccacacggagttgatgtgggttacggcctttctggcatggcaacggacgtcttttgccccataaccaaacttggatttggctgagtgtgggggcgtcaggctgcaagcttcctctacggatagcaagttagccttcacttttgacgccgctgctttaacctccttgagtacgtcctggtaatggctgtccagaacttgcagtctgtcaaatgtgactttcttctgcctttggcaagcactgcgtgaggtggtggaatacaccaaattgtggtgacgtagcaacgagttgcttagtgcattgatgggcagtttctgttcttccgcggcgcacggggtgacgagtgcgcctgtccaagagtaagacattgagcagcacacgacatcctccgcgttggcctcactactgaccgttgaccatgacccgtcgctaagatccggatccccaggctccccctccagggggggcatggaggaataggactcagcgtcggagtcgggggggcagccagaaggggcgggctcagaggatgttgtcgtattgtcgcccgtaatgccggaagttgaggagctgccaaagcttctggtggcgagctcggccaaggcagtagatagggttgattcagtgaggaccaccgtccgcttcttccgaggcggaggcacaggaggggactttggaggtggaagcggacagccatggaccacaggtggttcgtagtcgggctttttccacgtctccactagcggggggttatagtccggccgcgcccaaacgggcagggcctgggcgaatctccgagacttccgcaggatttctgcgggtacggagatctcccgctcgtcctcctccgccacaagcggatcgaaggagtccagaatcaccactttgttttctgactcaaccctggtgatgttgccgcccatctcctgcctccataggaggttggcctctatgagctcagcatcaggggagtcatggttagcggtgcaagttgccttgagagatggagcggatagctggctagccgaggagctggccacagaggggggtgatcccctcgccaaccttcgcccggccgcctctgctgttatatgggagggatcagtgagcatggacgtcaacacggccacgtccggttcgggctcgcaaggtaattgcgaccctaccgggtattcgtggagtcctactctgaatgatacctcctcccgcagcaagggcttgcaggggggcgcaaacctatgtaggcgcaccccgtccaattctgtgaaaaattcgggcgatgggacctggcacgggcatttgagattgtcagtagtcatacccgtcacgtagtggaagtcccccacctgccttatctccacatattcctctgcagacaccctccatagcgcgaacgtgtagttcggcgcaggaaggggggtacaggggcccgtggtgtaggcattaatggggaaggtcccactccacatgttcctgcaggtcctaggaccgacgatcctcatcgtcccgtttttgacatgtccagtgatctcagctccacagtggcagcgagtgtgcatgatgccgtccactcgccagacccccttatacccgcgctggcaggacacaaaggggatcccaggcagctgtggcatgagcttagcttttagccaggtcttaaagtcgctcaacacctcgcatatccagtcccagatgtcccttagccaggaaccggagcatggagtggtacactccgagcttatccactggtgcagtcgcctcaggagctgggttacagtgaggctgctgagtatggcagtgacgcgggcagctgcatcgctctccggcacgtagtgcgtgggggaaacatggttcccccgggaggcgaaggctatcagccggttcatccactgcactgccccctcgcccgggccaacgtgccggcgcagtattgctgcacagaccacgccgactacgagggctccgggcgagaggatggcgggcagtagattgaccaggtcctccgtggaggggacctcaccgctcatgatcttgaatgccacaagagctcccgccacgcccgcgccataccctgcaaggatgtctatgaggaccttccccagtccaacactgccgatggcggcgccagctaagccagcgcccacaaaggcagtagcggcaccgggggcggcgagctgggcagccacccacccccccaatatgttgaagaggagggtttggctagtggttagtgggctggtgacagcagctgtaaaagccatcaatgaagcaatggcggggttaccaggcagcgttgacaagcccgccaagtattgtatcccactgatgaagttccacatatgcttcgcccagaaggtctcgagtttttgccagttggtctggacagcaggggcgataacctctgcctgacgggacgcggtctgcaggaggccgagggccttctgcttgaactgctcggcgagcatcatcccttgctcgatgtacggtaagtgctgagagcactcttccatctcatcgaactctcggtagaggacttccctgtcaggtatgattgccggcttcccggacaagacgaccctgcccactatgaccacgcagcctgttgacaggcaatacgcggccaaagcagccaggacgccgccaacgagcacccaggtgctcgtgacgacctccaggtcggccgacatgcatgtcatgatgtatttggtgactgggtgcgtcagggtgatttcattctgaacagcgcccagtctgtatagcaggggtgttggcccatggagggtgggcttgaggcgaatcaaacacttccacatctggtcccacgatgggggaggggcttgagccctagcgcacacggtggcttggtacgctaccaggtaaggaaggttctccccactctgctttgtctgggatagaaagtgggcatctatatgagtgaggcctgtaaagacgccctcccaaaattcaagatggtcctggcacacgggaagccccggggtgttcatgtacgctcgtagcctaactgtagtctcggcgggcgtgagctcataccaagcacagcctgcgtcatagcactcacagaggacggacgagtcgaacatgccggaggggcgctcccccggtgccacaaatctgtagatgcctggcttccccctgccagtcctgccccgacgttgagtgcgggagacagcatcctgggggagcgtgattgtctcaatggtgaaggtagggtcaaggctgaaatcgactgtctgggtgacacacgtattgcagtctatcaccgagtcgaagtcgccggtatagccggtcatgagggcatcggttgccacgacgacaacatcgccgctggtcgggatgacggacacgtcaagaccgcggtagtaggccacggcattgatgcccaatgcgaccagctttgcggcgagttcgtcgcacttcttctttgaatgacagaagatgagatgtctcccccccttgattacttcgagggggatagccttgccgtaaaaagggatctctccggtggtggacagagcaacctcctcgatgttgggatggggcacagtgacggagcccggaggggtggcggtggcgagcacaaccagtctcgcccccgcagtctctgcttggtcaaggacagtgccgatgcccaagatggatgtggcatccgtggagtggcactcgtcacaaattattatgtcataaccgccccccgagcacccgccgtcggcaaggaacttgccgtaggtggagtacgtgatggggctgccagtggtaattgttctcaccccggtcctgatgttaggatcgatcccatgagccttggacatgtaagcaccaaagcccagtgttgcagcaacagaggggttgagtactagcaccttatagccctgagctgcatatgcagccgggaccttggtgcttttgccgctgcctgtgggagcatggaggtgagccacctggaagctctggggcactactggtggagaggagttatccgtgaacaccggggacctcatggttgtctctaggttctccacagggataaagtccaccgccttagccactccacgggtgcacaccgcggccctaaatatgcccacggcgtgccccgcggggcacaacagcggaccccccgaggagcctttcaagtaggaaatgggccggggcgacagcaggctgcccctgctatcaccccgccggcgcacgggaatgacatcggcgtgcctcgtgaccaggtaaaggtccgaggagccgcaagtgcagggtgtcaatgagcggctaccttgcggagcgggccagcccacaaggtcttggtctacattggtatacatctggatgacaggacccttgggtgacgcgatggtcctcgttccggccccgtggtagacagtccagcacaccccattgatgcacgttgccaggaaggtttgggcagcagttgacacaatctggacctcaccctccacttggtttttgtcccggccagttaggctggtgattatgcaccctaggaggccccttgtctgctgggcgtacgccgtgatgggcgccagcaacctccaccccttggagaccattccatcggctggcccgagcagtatctcccggcccctgcgggcggaaacaggcaagccgttgatgatgtcaccgcacgcggcggtatctgccccccacgtgatgagcttggtctccatttgggagaagacgactggctctacagccacggccagatctcgcaagccgttgtgcgcccagtcccgaagaggagtgagatggttataaacataggtgccagtaagcgcccctaacttaatgatgaccatttgcacgtaatggcctccgatcatcttccgcgctaacgcgcagaaccggagaaggccttggacgcgcacaaagtagggtactttaagcaaactggcttgaagaatccaaaggggtccgaagacggccagcagcaatttggtgatgtcaaataccagagtcgggtgtacagcacacatgagtaagatgacggcgtcgcgcccccctcggacgttgagggggggaatccacacgtgcagttgcgcttccactctggtcagaaaatactgaagccaccacaagcaccagctgatatagcgcttgtaatatggtgacagagtcagcgccatcaacccgacgagaacaacaccgccacacgacgcggccacctccgtgtccagcgcgtacgcccgctggggcaacgccaacaggagcaggaggagaggccacatcccgtagaaggtgtagaccgctccgggcacccacttacccttcaaataccatgcaaagcagaagaacacgaggaaggatacaagaccgtgcgtcccggccagggatgctgcattaagtattacgaggttctccaaagccgcctccgcttgggatatgagtagcatcatccacaagcaggagcagacgcgcgcgtctgcaagcagaaggaacaggagaacgacgtactcccacttaatggcccaggacgcgatgcttgaccccaccccgtacaagtactgcacgtccacaatgttctggtggaggtggatgaggccggtggacaaggctggtagggttgtgaaggaacacgggaggacctgccactgtgtagtggtcagcagtaacggggtgagctcggacctgtccctgtcttccagatcgcaacgttcgccccgcgtccagttgcaggcagcttccagcctgtgttcgacccctcccacgtacatcctgattttaaatatggtgtagttgatggtacaaggataatgccaaagcctatacgggtagtcgaccaggcacctgggtgtgatccagggaccggagccgcaccgagagtatgtggcgtccggatgcttgcggaagcaatcagtggggcagtgcagggtgttgttgcccgcccctccgatgacacaaggaggcgctccgcacactttggtgaatccagttgagttcatccaggtacaaccgaaccaattgcccagcggtggcctggtattgttaaggacgaagacgtccgtatcattttcaccccagctgtaggtgggcgcgcccgacctgtcggtcgttcccaccaccacggggctgggagtgaagcaatataccggaccacacacactcttcgcgggcacaataccgcaaggttttggggggtagtgccagcagtaggggcgctggtcggggccgcttccgttggcataactgatagggccccagccctggtcaaaatcggtaaggggtcggcagctggctagcctctcaggacagcctgaagagttgaacttgtggtgatagaaaagccctgccaaccagccggtgttgaggctatcattgcagttcagggccgtgctattgaggtgccaactgccgttggtgttgatcagctggacgttctgcttggcgcctggtgcgaggaggctaacaaatccagacacagtgtggccggcacttcccccggtgacgtgggtttccgcgtcgacgccggcaaatagcagcagcactaccaggaccttcgcccagttccccaccatggagaaatacgctatgcccgccaggactccccagtgagcaccagcgatcatgtccaagatggcttgtgggatccggagcagctgagccattaccaacgccgtcgtaggggaccagttcatcatcatatcccatgccatgcggtgacccgttatatggccgggatagatagagcaattgcaaccttgcgtcgtccagtggcgcctgggagagaaggtgaacagttggccgacaagaaagacagacccgcataggtcccccacgtagagggccgaacagagggtggcgctcccgacaagcagatcgatgtgacgtcgaagctgcgtcgcggggagtttgccatccctggtggccaccgtaggggtcatcgccacccaacacctcgaggcgttgccctcacgaacgcaagggacgcaccccggagtgtgcaggatggcatcggccgcctcgtacacaatactcgagttagggcaatcattggtgacgtggtaaagccccgtggagttgcgcacttggtaggccgaagcgggcacagtcaagcaagagagcagggccagaaggaagatagagaaagagcaaccaggaaggttccctgttgcatagttcacgccgtcttccagaacccggacgccatgcgccagggccctggcagcgcctccaagaggggcgccgacgagcggtatgtaccccatgaggtcggcgaagccgcacgtaagggtatcgatgaccttacccaaattgcgcgacctacgccgggggtctgtggggccccagctaggccgagagccacggggagacaggagccatcccgcccacccgcagccctcattgccatagaggggccaagggtacccgggctgagcccaggtcctgccctcgggccgacgagccttggggataggctgacgtctacctcgaggttgcgaccgctcggaagtctttctcgtcgcgcgcacacccaatctagggcccctgcgcggcaacaagtaaactccaccaacgatctgaccgccacccgggaacttgacgtcctgtgggcgacggttggtgttacgtttgttttttttttgaggtttaggattcgtgctcatggtgcacggtctacgagacctcccggggcactcgcaagcaccctatcaggcagtaccacaaggcctttcgcgacccaacactactcggctagcagtcttgcgggggcacgcccaaatctccaggcattgagcgggttgatccaagaaaggacccggtcgtcctggcaattccggtgtactcaccggttccgcagaccactatggctctcccgggagggggggtcctggaggctgcacgacactcatactaacgccatggctagacgctttctgcgtgaagacagtagttcctcacaggggagtgattcatggtggagtg

SEQ ID NO: 124 - protein, 2955 aa
  Duplication 9: /note= "A heterogeneity exists at Xaa which is either Lys or Arg"
  Duplication 11: /note= "A heterogeneity  exists at Xaa which is either Asn or Thr"
  Duplication 176: /note= "A  heterogeneity exists at Xaa which is either Ile or Thr"
  Duplication 334: /note= "A heterogeneity exists at Xaa which is either Met or Val"
  Duplication 603: /note= "A heterogeneity exists at Xaa which is either Leu or Ile"
  Duplication 848: /note= "A heterogeneity exists at Xaa which is either Tyr or Asn"
  Duplication 1276: /note= "A  heterogeneity exists at Xaa which is either Pro or Leu"
  Duplication 1454: /note= "A heterogeneity exists at Xaa which is either Cys or Tyr"
  Duplication 1471: /note= "A heterogeneity exists  at Xaa which is either Thr or Ser"
  Duplication 1877: /note= "A heterogeneity exists at Xaa which is either Glu or Gly"
  Duplication 1948: /note= "A heterogeneity exists  at Xaa which is either Leu or His"
  Duplication 1949: /note= "A heterogeneity exists at Xaa which is either Ser or Cys"
  Duplication 2021: /note= "A  heterogeneity exists at Xaa which is either Gly or Val"
  Duplication 2349: /note= "A heterogeneity exists at Xaa which is either Thr or Ser"
  Duplication 2385: /note= "A heterogeneity exists at Xaa which is either Tyr or Phe"
  Duplication 2386: /note= "A heterogeneity exists at Xaa which is either Ser or Ala"
  Duplication 2502: /note= "A heterogeneity exists at Xaa which is either Leu or Phe"
  Duplication 2690: /note= "A heterogeneity exists at Xaa which is either Arg or Gly"
  Duplication 2921: /note= "A heterogeneity exists at Xaa which is either Arg or Gly"
MSTNPKPQXKXKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGSAARALAHGVRVLEDGVNYATGNLPGCSFSXFLLALLSCLTVPASAYQVRNSTGLYHVTNDCPNSSIVYEAADAILHTPGCVPCVREGNASRCWVAMTPTVATRDGKLPATQLRRHIDLLVGSATLCSALYVGDLCGSVFLVGQLFTFSPRRHWTTQGCNCSIYPGHITGHRMAWDMMMNWSPTTALVXAQLLRIPQAILDMIAGAHWGVLAGIAYFSMVGNWAKVLVVLLLFAGVDAETHVTGGSAGHTVSGFVSLLAPGAKQNVQLINTNGSWHLNSTALNCNDSLNTGWLAGLFYHHKFNSSGCPERLASCRPLTDFDQGWGPISYANGSGPDQRPYCWHYPPKPCGIVPAKSVCGPVYCFTPSPVVVGTTDRSGAPTYSWGENDTDVFVLNNTRPPLGNWFGCTWMNSTGFTKVCGAPPCVIGGAGNNTLHCPTDCFRKHPDATYSRCGSGPWXTPRCLVDYPYRLWHYPCTINYTIFKIRMYVGGVEHRLEAACNWTRGERCDLEDRDRSELSPLLLTTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGKWVPGAVYTFYGMWPLLLLLLALPQRAYALDTEVAASCGGVVLVGLMALTLSPYYKRYISWCLWWLQXFLTRVEAQLHVWIPPLNVRGGRDAVILLMCAVHPTLVFDITKLLLAVFGPLWILQASLLKVPYFVRVQGLLRFCALARKMIGGHYVQMVIIKLGALTGTYVYNHLTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVENLETTMRSPVFTDNSSPPVVPQSFQVAHLHAPTGSGKSTKVPAAYAAQGYKVLVLNPSVAATLGFGAYMSKAHGIDXNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGYTGDFDSVIDXNTCVTQTVDFSLDPTFXIETITLPQDAVSRTQRRGRTGRGKPGINRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEITLTHPVTKYIMTCMSADLEVVTSTWVLVGGVLAALAAYCLSTGCVVIVGRVVLSGKPAIIPDREVLYREFDEMEECSQHLPYIEQGMMLAEQFKQKALGLLQTASRQAEVIAPAVQTNWQKLETFWAKHMWNFISGIQYLAGLSTLPGNPAIASLMAFTAAVTSPLTTSQTLLFNILGGWVAAQLAAPGAATAFVGAGLAGAAIGSVGLGKVLIDILAGYGAGVAGALVAFKIMSGEVPSTXDLVNLLPAILSPGALVVGVVCAAILRRHVGPGEGAVQWMNRLIAFASRGNHVSPTHYVPESDAAARVTAIXXSLTVTQLLRRLHQWISSECTTPCSGSWLRDIWDWICEVLSDFKTWLKAKLMPQLPGIPFVSCQRGYKGVWRXDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGGNITRVESENKVVILDSFDPLVAEEDEREISVPAEILRKSRRFAQALPVWARPDYNPPLVETWKKPDYEPPVVHGCPLPPPKSPPVPPPRKKRTVVLTESTLSTALAELAXRSFGSSSTSGITGDNTTTSSEPAPSGCPPDSDAESXXSMPPLEGEPGDPDLSDGSWSTVSSEANAEDVVCCSMSYSWTGALVTPCAAEEQKLPINALSNSLLRHHNLVYSTTSRSACQRQKKVTFDRLQVLDSHYQDVLKEVKAAASKVKANXLSVEEACSLTPPHSAKSKFGYGAKDVRCHARKAVTHINSVWKDLLEDNVTPIDTTIMAKNEVFCVQPEKGGRKPARLIVFPDLGVRVCEKMALYDVVTKLPLAVMGSSYGFQYSPGQRVEFLVQAWKSKKTPMGFSYDTRCFDSTVTESDIRTEEAIYQCCDLDPQARVAIKSLTERLYVGGPLTNSXGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWXHRARSVRARLLARGGRAAICGKYLFNWAVRTKLK

SEQ ID NO: 125 - protein, 6 aa
TATPPG

SEQ ID NO: 126 - protein, 13 aa
SAAQRRGRIGRNP

SEQ ID NO: 127 - protein, 6 aa
GDDCVV

SEQ ID NO: 128 - protein, 6 aa
TATPPG

SEQ ID NO: 129 - protein, 13 aa
SRTQRRGRTGRGK

SEQ ID NO: 130 - protein, 6 aa
GDDLVV

SEQ ID NO: 131 - DNA (other nucleic acid), 18 bp; single-stranded, linear
  description: /desc = "transfer vector pAc373"
cccgagatccgcggatcc

SEQ ID NO: 132 - DNA (other nucleic acid), 50 bp; single-stranded, linear
  description: /desc = "transfer vector pVL985"
cctataaatattccggattattcataccgtcccaccatcgggccggatcc

SEQ ID NO: 133 - DNA (genomic), 42 bp; single-stranded, linear
  CDS 10..42
cctataaatatgccggattattcataccgtcccaccatcggg

SEQ ID NO: 134 - protein, 11 aa
MPDYSYRPTIG

SEQ ID NO: 135 - DNA (cDNA), 182 bp; single-stranded, linear
  CDS 1..180
  immediate source clone: 6k
ggcagggctgccatatgtggcaagtacctcttcaactgggcagtaagaacaaagctcaaactcactccaatagcggccgctggccagctggacttgtccggctggttcacggctggctacagcgggggagacatttatcacagcgtgtctcatgcccggccccgctggatctggttttgccc

SEQ ID NO: 136 - protein, 60 aa
GRAAICGKYLFNWAVRTKLKLTPIAAAGQLDLSGWFTAGYSGGDIYHSVSHARPRWIWFC

SEQ ID NO: 137 - DNA (cDNA), 8987 bp; single-stranded, linear
  CDS 1..8985
atgagcacgaatcctaaacctcaaaaaaaaaacaaacgtaacaccaaccgtcgcccacaggacgtcaagttcccgggtggcggtcagatcgttggtggagtttacttgttgccgcgcaggggccctagattgggtgtgcgcgcgacgagaaagacttccgagcggtcgcaacctcgaggtagacgtcagcctatccccaaggctcgtcggcccgagggcaggacctgggctcagcccgggtacccttggcccctctatggcaatgagggctgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaagcgctgccagggccctggcgcatggcgtccgggttctggaagacggcgtgaactatgcaacagggaaccttcctggttgctctttctctatcttccttctggccctgctctcttgcttgactgtgcccgcttcggcctaccaagtgcgcaactccacggggctttaccacgtcaccaatgattgccctaactcgagtattgtgtacgaggcggccgatgccatcctgcacactccggggtgcgtcccttgcgttcgtgagggcaacgcctcgaggtgttgggtggcgatgacccctacggtggccaccagggatggcaaactccccgcgacgcagcttcgacgtcacatcgatctgcttgtcgggagcgccaccctctgttcggccctctacgtgggggacctatgcgggtctgtctttcttgtcggccaactgttcaccttctctcccaggcgccactggacgacgcaaggttgcaattgctctatctatcccggccatataacgggtcaccgcatggcatgggatatgatgatgaactggtcccctacgacggcgttggtaatggctcagctgctccggatcccacaagccatcttggacatgatcgctggtgctcactggggagtcctggcgggcatagcgtatttctccatggtggggaactgggcgaaggtcctggtagtgctgctgctatttgccggcgtcgacgcggaaacccacgtcaccgggggaagtgccggccacactgtgtctggatttgttagcctcctcgcaccaggcgccaagcagaacgtccagctgatcaacaccaacggcagttggcacctcaatagcacggccctgaactgcaatgatagcctcaacaccggctggttggcagggcttttctatcaccacaagttcaactcttcaggctgtcctgagaggctagccagctgccgaccccttaccgattttgaccagggctggggccctatcagttatgccaacggaagcggccccgaccagcgcccctactgctggcactaccccccaaaaccttgcggtattgtgcccgcgaagagtgtgtgtggtccggtatattgcttcactcccagccccgtggtggtgggaacgaccgacaggtccggcgcgcccacctacagctggggtgaaaatgatacggacgtcttcgtccttaacaataccaggccaccgctgggcaattggttcggttgtacctggatgaactcaactggattcaccaaagtgtgcggagcgcctccttgtgtcatcggaggggcgggcaacaacaccctgcactgccccactgattgcttccgcaagcatccggacgccacatactctcggtgcggctccggtccctggatcacacccaggtgcctggtcgactacccgtataggctttggcattatccttgtaccatcaactacaccatatttaaaatcaggatgtacgtgggaggggtcgaacacaggctggaagctgcctgcaactggacgcggggcgaacgttgcgatctggaagacagggacaggtccgagctcagcccgttactgctgaccactacacagtggcaggtcctcccgtgttccttcacaaccctaccagccttgtccaccggcctcatccacctccaccagaacattgtggacgtgcagtacttgtacggggtggggtcaagcatcgcgtcctgggccattaagtgggagtacgtcgttctcctgttccttctgcttgcagacgcgcgcgtctgctcctgcttgtggatgatgctactcatatcccaagcggaggcggctttggagaacctcgtaatacttaatgcagcatccctggccgggacgcacggtcttgtatccttcctcgtgttcttctgctttgcatggtatttgaagggtaagtgggtgcccggagcggtctacaccttctacgggatgtggcctctcctcctgctcctgttggcgttgccccagcgggcgtacgcgctggacacggaggtggccgcgtcgtgtggcggtgttgttctcgtcgggttgatggcgctgactctgtcaccatattacaagcgctatatcagctggtgcttgtggtggcttcagtattttctgaccagagtggaagcgcaactgcacgtgtggattccccccctcaacgtccgaggggggcgcgacgccgtcatcttactcatgtgtgctgtacacccgactctggtatttgacatcaccaaattgctgctggccgtcttcggacccctttggattcttcaagccagtttgcttaaagtaccctactttgtgcgcgtccaaggccttctccggttctgcgcgttagcgcggaagatgatcggaggccattacgtgcaaatggtcatcattaagttaggggcgcttactggcacctatgtttataaccatctcactcctcttcgggactgggcgcacaacggcttgcgagatctggccgtggctgtagagccagtcgtcttctcccaaatggagaccaagctcatcacgtggggggcagataccgccgcgtgcggtgacatcatcaacggcttgcctgtttccgcccgcaggggccgggagatactgctcgggccagccgatggaatggtctccaaggggtggaggttgctggcgcccatcacggcgtacgcccagcagacaaggggcctcctagggtgcataatcaccagcctaactggccgggacaaaaaccaagtggagggtgaggtccagattgtgtcaactgctgcccaaaccttcctggcaacgtgcatcaatggggtgtgctggactgtctaccacggggccggaacgaggaccatcgcgtcacccaagggtcctgtcatccagatgtataccaatgtagaccaagaccttgtgggctggcccgctccgcaaggtagccgctcattgacaccctgcacttgcggctcctcggacctttacctggtcacgaggcacgccgatgtcattcccgtgcgccggcggggtgatagcaggggcagcctgctgtcgccccggcccatttcctacttgaaaggctcctcggggggtccgctgttgtgccccgcggggcacgccgtgggcatatttagggccgcggtgtgcacccgtggagtggctaaggcggtggactttatccctgtggagaacctagagacaaccatgaggtccccggtgttcacggataactcctctccaccagtagtgccccagagcttccaggtggctcacctccatgctcccacaggcagcggcaaaagcaccaaggtcccggctgcatatgcagctcagggctataaggtgctagtactcaacccctctgttgctgcaacactgggctttggtgcttacatgtccaaggctcatgggatcgatcctaacatcaggaccggggtgagaacaattaccactggcagccccatcacgtactccacctacggcaagttccttgccgacggcgggtgctcggggggcgcttatgacataataatttgtgacgagtgccactccacggatgccacatccatcttgggcatcggcactgtccttgaccaagcagagactgcgggggcgagactggttgtgctcgccaccgccacccctccgggctccgtcactgtgccccatcccaacatcgaggaggttgctctgtccaccaccggagagatccctttttacggcaaggctatccccctcgaagtaatcaagggggggagacatctcatcttctgtcattcaaagaagaagtgcgacgaactcgccgcaaagctggtcgcattgggcatcaatgccgtggcctactaccgcggtcttgacgtgtccgtcatcccgaccagcggcgatgttgtcgtcgtggcaaccgatgccctcatgaccggctataccggcgacttcgactcggtgatagactgcaatacgtgtgtcacccagacagtcgatttcagccttgaccctaccttcaccattgagacaatcacgctcccccaggatgctgtctcccgcactcaacgtcggggcaggactggcagggggaagccaggcatcaacagatttgtggcaccgggggagcgcccctccggcatgttcgactcgtccgtcctctgtgagtgctatgacgcaggctgtgcttggtatgagctcacgcccgccgagactacagttaggctacgagcgtacatgaacaccccggggcttcccgtgtgccaggaccatcttgaattttgggagggcgtctttacaggcctcactcatatagatgcccactttctatcccagacaaagcagagtggggagaaccttccttacctggtagcgtaccaagccaccgtgtgcgctagggctcaagcccctcccccatcgtgggaccagatgtggaagtgtttgattcgcctcaagcccaccctccatgggccaacacccctgctatacagactgggcgctgttcagaatgaaatcaccctgacgcacccagtcaccaaatacatcatgacatgcatgtcggccgacctggaggtcgtcacgagcacctgggtgctcgttggcggcgtcctggctgctttggccgcgtattgcctgtcaacaggctgcgtggtcatagtgggcagggtcgtcttgtccgggaagccggcaatcatacctgacagggaagtcctctaccgagagttcgatgagatggaagagtgctctcagcacttaccgtacatcgagcaagggatgatgctcgccgagcagttcaagcagaaggccctcggcctcctgcagaccgcgtcccgtcaggcagaggttatcgcccctgctgtccagaccaactggcaaaaactcgagaccttctgggcgaagcatatgtggaacttcatcagtgggatacaatacttggcgggcttgtcaacgctgcctggtaaccccgccattgcttcattgatggcttttacagctgctgtcaccagcccactaaccactagccaaaccctcctcttcaacatattgggggggtgggtggctgcccagctcgccgcccccggtgccgctactgcctttgtgggcgctggcttagctggcgccgccatcggcagtgttggactggggaaggtcctcatagacatccttgcagggtatggcgcgggcgtggcgggagctcttgtggcattcaagatcatgagcggtgaggtcccctccacggaggacctggtcaatctactgcccgccatcctctcgcccggagccctcgtagtcggcgtggtctgtgcagcaatactgcgccggcacgttggcccgggcgagggggcagtgcagtggatgaaccggctgatagccttcgcctcccgggggaaccatgtttcccccacgcactacgtgccggagagcgatgcagctgcccgcgtcactgccatactcagcagcctcactgtaacccagctcctgaggcgactgcaccagtggataagctcggagtgtaccactccatgctccggttcctggctaagggacatctgggactggatatgcgaggtgttgagcgactttaagacctggctaaaagctaagctcatgccacagctgcctgggatcccctttgtgtcctgccagcgcgggtataagggggtctggcgagtggacggcatcatgcacactcgctgccactgtggagctgagatcactggacatgtcaaaaacgggacgatgaggatcgtcggtcctaggacctgcaggaacatgtggagtgggaccttccccattaatgcctacaccacgggcccctgtaccccccttcctgcgccgaactacacgttcgcgctatggagggtgtctgcagaggaatatgtggagataaggcaggtgggggacttccactacgtgacgggtatgactactgacaatctcaaatgcccgtgccaggtcccatcgcccgaatttttcacagaattggacggggtgcgcctacataggtttgcgcccccctgcaagcccttgctgcgggaggaggtatcattcagagtaggactccacgaatacccggtagggtcgcaattaccttgcgagcccgaaccggacgtggccgtgttgacgtccatgctcactgatccctcccatataacagcagaggcggccgggcgaaggttggcgaggggatcacccccctctgtggccagctcctcggctagccagctatccgctccatctctcaaggcaacttgcaccgctaaccatgactcccctgatgctgagctcatagaggccaacctcctatggaggcaggagatgggcggcaacatcaccagggttgagtcagaaaacaaagtggtgattctggactccttcgatccgcttgtggcggaggaggacgagcgggagatctccgtacccgcagaaatcctgcggaagtctcggagattcgcccaggccctgcccgtttgggcgcggccggactataaccccccgctagtggagacgtggaaaaagcccgactacgaaccacctgtggtccatggctgtccgcttccacctccaaagtcccctcctgtgcctccgcctcggaagaagcggacggtggtcctcactgaatcaaccctatctactgccttggccgagctcgccaccagaagctttggcagctcctcaacttccggcattacgggcgacaatacgacaacatcctctgagcccgccccttctggctgcccccccgactccgacgctgagtcctattcctccatgccccccctggagggggagcctggggatccggatcttagcgacgggtcatggtcaacggtcagtagtgaggccaacgcggaggatgtcgtgtgctgctcaatgtcttactcttggacaggcgcactcgtcaccccgtgcgccgcggaagaacagaaactgcccatcaatgcactaagcaactcgttgctacgtcaccacaatttggtgtattccaccacctcacgcagtgcttgccaaaggcagaagaaagtcacatttgacagactgcaagttctggacagccattaccaggacgtactcaaggaggttaaagcagcggcgtcaaaagtgaaggctaacttgctatccgtagaggaagcttgcagcctgacgcccccacactcagccaaatccaagtttggttatggggcaaaagacgtccgttgccatgccagaaaggccgtaacccacatcaactccgtgtggaaagaccttctggaagacaatgtaacaccaatagacactaccatcatggctaagaacgaggttttctgcgttcagcctgagaaggggggtcgtaagccagctcgtctcatcgtgttccccgatctgggcgtgcgcgtgtgcgaaaagatggctttgtacgacgtggttacaaagctccccttggccgtgatgggaagctcctacggattccaatactcaccaggacagcgggttgaattcctcgtgcaagcgtggaagtccaagaaaaccccaatggggttctcgtatgatacccgctgctttgactccacagtcactgagagcgacatccgtacggaggaggcaatctaccaatgttgtgacctcgacccccaagcccgcgtggccatcaagtccctcaccgagaggctttatgttgggggccctcttaccaattcaaggggggagaactgcggctatcgcaggtgccgcgcgagcggcgtactgacaactagctgtggtaacaccctcacttgctacatcaaggcccgggcagcctgtcgagccgcagggctccaggactgcaccatgctcgtgtgtggcgacgacttagtcgttatctgtgaaagcgcgggggtccaggaggacgcggcgagcctgagagccttcacggaggctatgaccaggtactccgccccccctggggaccccccacaaccagaatacgacttggagctcataacatcatgctcctccaacgtgtcagtcgcccacgacggcgctggaaagagggtctactacctcacccgtgaccctacaacccccctcgcgagagctgcgtgggagacagcaagacacactccagtcaattcctggctaggcaacataatcatgtttgcccccacactgtgggcgaggatgatactgatgacccatttctttagcgtccttatagccagggaccagcttgaacaggccctcgattgcgagatctacggggcctgctactccatagaaccacttgatctacctccaatcattcaaagactccatggcctcagcgcattttcactccacagttactctccaggtgaaattaatagggtggccgcatgcctcagaaaacttggggtaccgcccttgcgagcttggagacaccgggcccggagcgtccgcgctaggcttctggccagaggaggcagggctgccatatgtggcaagtacctcttcaactgggcagtaagaacaaagctcaaactcactccaatagcggccgctggccagctggacttgtccggctggttcacggctggctacagcgggggagacatttatcacagcgtgtctcatgcccggccccgctggatctggttttgccc

SEQ ID NO: 138 - protein, 2995 aa
MSTNPKPQKKNKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGSAARALAHGVRVLEDGVNYATGNLPGCSFSIFLLALLSCLTVPASAYQVRNSTGLYHVTNDCPNSSIVYEAADAILHTPGCVPCVREGNASRCWVAMTPTVATRDGKLPATQLRRHIDLLVGSATLCSALYVGDLCGSVFLVGQLFTFSPRRHWTTQGCNCSIYPGHITGHRMAWDMMMNWSPTTALVMAQLLRIPQAILDMIAGAHWGVLAGIAYFSMVGNWAKVLVVLLLFAGVDAETHVTGGSAGHTVSGFVSLLAPGAKQNVQLINTNGSWHLNSTALNCNDSLNTGWLAGLFYHHKFNSSGCPERLASCRPLTDFDQGWGPISYANGSGPDQRPYCWHYPPKPCGIVPAKSVCGPVYCFTPSPVVVGTTDRSGAPTYSWGENDTDVFVLNNTRPPLGNWFGCTWMNSTGFTKVCGAPPCVIGGAGNNTLHCPTDCFRKHPDATYSRCGSGPWITPRCLVDYPYRLWHYPCTINYTIFKIRMYVGGVEHRLEAACNWTRGERCDLEDRDRSELSPLLLTTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGKWVPGAVYTFYGMWPLLLLLLALPQRAYALDTEVAASCGGVVLVGLMALTLSPYYKRYISWCLWWLQYFLTRVEAQLHVWIPPLNVRGGRDAVILLMCAVHPTLVFDITKLLLAVFGPLWILQASLLKVPYFVRVQGLLRFCALARKMIGGHYVQMVIIKLGALTGTYVYNHLTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVENLETTMRSPVFTDNSSPPVVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGYTGDFDSVIDCNTCVTQTVDFSLDPTFTIETITLPQDAVSRTQRRGRTGRGKPGINRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEITLTHPVTKYIMTCMSADLEVVTSTWVLVGGVLAALAAYCLSTGCVVIVGRVVLSGKPAIIPDREVLYREFDEMEECSQHLPYIEQGMMLAEQFKQKALGLLQTASRQAEVIAPAVQTNWQKLETFWAKHMWNFISGIQYLAGLSTLPGNPAIASLMAFTAAVTSPLTTSQTLLFNILGGWVAAQLAAPGAATAFVGAGLAGAAIGSVGLGKVLIDILAGYGAGVAGALVAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYKGVWRVDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGGNITRVESENKVVILDSFDPLVAEEDEREISVPAEILRKSRRFAQALPVWARPDYNPPLVETWKKPDYEPPVVHGCPLPPPKSPPVPPPRKKRTVVLTESTLSTALAELATRSFGSSSTSGITGDNTTTSSEPAPSGCPPDSDAESYSSMPPLEGEPGDPDLSDGSWSTVSSEANAEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVTHINSVWKDLLEDNVTPIDTTIMAKNEVFCVQPEKGGRKPARLIVFPDLGVRVCEKMALYDVVTKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARSVRARLLARGGRAAICGKYLFNWAVRTKLKLTPIAAAGQLDLSGWFTAGYSGGDIYHSVSHARPRWIWFC

SEQ ID NO: 139 - DNA (other nucleic acid), 60 bp; single-stranded, linear
  description: /desc = "linker used in the construction of pS3-56c100m."
ccgggcgagggggcagtgcagtggatgaaccggctgatagccttcgcctcccgggggaac

SEQ ID NO: 140 - DNA (other nucleic acid), 56 bp; single-stranded, linear
  description: /desc = "linker used in the construction of pS3-56C100m."
  anti-sense: YES
gttcccccgggaggcgaaggctatcagccggttcatccactgcactgccccctcgc

SEQ ID NO: 141 - DNA (other nucleic acid), 19 bp; single-stranded, linear
  description: /desc = "linker used in the construction of pS3-56c100m"
catgtttccccctaatgag

SEQ ID NO: 142 - DNA (other nucleic acid), 22 bp; single-stranded, linear
  description: /desc = "linker used in the construction of pS3-56c100m"
cgactcattagggggaaacatg

SEQ ID NO: 143 - DNA (cDNA), 307 bp; single-stranded, linear
  CDS 1..306
  immediate source clone: 31
gaattcgggtccgtcatcccgaccagcggcgatgttgtcgtcgtggcaaccgatgccctcatgaccggctataccggcgacttcgactcggtgatagactgcaatacgtgtgtcacccagacagtcgatttcagccttgaccctaccttcaccattgagacaatcacgctcccccaagatgctgtctcccgcactcaacgtcggggcaggactggcagggggaagccaggcatctacagatttgtggcaccgggggagcgccctccggcatgttcgactcgtccgtcctctgtgagtgcccgaattc

SEQ ID NO: 144 - protein, 102 aa
EFGSVIPTSGDVVVVATDALMTGYTGDFDSVIDCNTCVTQTVDFSLDPTFTIETITLPQDAVSRTQRRGRTGRGKPGIYRFVAPGERPPACSTRPSSVSARI

SEQ ID NO: 145 - DNA (cDNA), 121 bp; single-stranded, linear
  CDS 2..94
  immediate source clone: p131jh
ttatcacagcgtgtctcatgcccggccccgctggatctggttttgcctactcctgcttgctgcaggggtaggcatctacctcctccccaaccgatgaaggttggggtaaacactccggcct

SEQ ID NO: 146 - protein, 31 aa
YHSVSHARPRWIWFCLLLLAAGVGIYLLPNR

SEQ ID NO: 147 - DNA (cDNA), 2219 bp; single-stranded, linear
  CDS 1..2217
gcggtggactttatccctgtggagaacctagagacaaccatgaggtccccggtgttcacggataactcctctccaccagtagtgccccagagcttccaggtggctcacctccatgctcccacaggcagcggcaaaagcaccaaggtcccggctgcatatgcagctcagggctataaggtgctagtactcaacccctctgttgctgcaacactgggctttggtgcttacatgtccaaggctcatgggatcgatcctaacatcaggaccggggtgagaacaattaccactggcagccccatcacgtactccacctacggcaagttccttgccgacggcgggtgctcggggggcgcttatgacataataatttgtgacgagtgccactccacggatgccacatccatcttgggcatcggcactgtccttgaccaagcagagactgcgggggcgagactggttgtgctcgccaccgccacccctccgggctccgtcactgtgccccatcccaacatcgaggaggttgctctgtccaccaccggagagatccctttttacggcaaggctatccccctcgaagtaatcaagggggggagacatctcatcttctgtcattcaaagaagaagtgcgacgaactcgccgcaaagctggtcgcattgggcatcaatgccgtggcctactaccgcggtcttgacgtgtccgtcatcccgaccagcggcgatgttgtcgtcgtggcaaccgatgccctcatgaccggctataccggcgacttcgactcggtgatagactgcaatacgtgtgtcacccagacagtcgatttcagccttgaccctaccttcaccattgagacaatcacgctcccccaggatgctgtctcccgcactcaacgtcggggcaggactggcagggggaagccaggcatcaacagatttgtggcaccgggggagcgcccctccggcatgttcgactcgtccgtcctctgtgagtgctatgacgcaggctgtgcttggtatgagctcacgcccgccgagactacagttaggctacgagcgtacatgaacaccccggggcttcccgtgtgccaggaccatcttgaattttgggagggcgtctttacaggcctcactcatatagatgcccactttctatcccagacaaagcagagtggggagaaccttccttacctggtagcgtaccaagccaccgtgtgcgctagggctcaagcccctcccccatcgtgggaccagatgtggaagtgtttgattcgcctcaagcccaccctccatgggccaacacccctgctatacagactgggcgctgttcagaatgaaatcaccctgacgcacccagtcaccaaatacatcatgacatgcatgtcggccgacctggaggtcgtcacgagcacctgggtgctcgttggcggcgtcctggctgctttggccgcgtattgcctgtcaacaggctgcgtggtcatagtgggcagggtcgtcttgtccgggaagccggcaatcatacctgacagggaagtcctctaccgagagttcgatgagatggaagagtgctctcagcacttaccgtacatcgagcaagggatgatgctcgccgagcagttcaagcagaaggccctcggcctcctgcagaccgcgtcccgtcaggcagaggttatcgcccctgctgtccagaccaactggcaaaaactcgagaccttctgggcgaagcatatgtggaacttcatcagtgggatacaatacttggcgggcttgtcaacgctgcctggtaaccccgccattgcttcattgatggcttttacagctgctgtcaccagcccactaaccactagccaaaccctcctcttcaacatattgggggggtgggtggctgcccagctcgccgcccccggtgccgctactgcctttgtgggcgctggcttagctggcgccgccatcggcagtgttggactggggaaggtcctcatagacatccttgcagggtatggcgcgggcgtggcgggagctcttgtggcattcaagatcatgagcggtgaggtcccctccacggaggacctggtcaatctactgcccgccatcctctcgcccggagccctcgtagtcggcgtggtctgtgcagcaatactgcgccggcacgttggcccgggcgagggggcagtgcagtggatgaaccggctgatagccttcgcctcccgggggaaccatgtttcccc

SEQ ID NO: 148 - protein, 739 aa
AVDFIPVENLETTMRSPVFTDNSSPPVVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGYTGDFDSVIDCNTCVTQTVDFSLDPTFTIETITLPQDAVSRTQRRGRTGRGKPGINRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEITLTHPVTKYIMTCMSADLEVVTSTWVLVGGVLAALAAYCLSTGCVVIVGRVVLSGKPAIIPDREVLYREFDEMEECSQHLPYIEQGMMLAEQFKQKALGLLQTASRQAEVIAPAVQTNWQKLETFWAKHMWNFISGIQYLAGLSTLPGNPAIASLMAFTAAVTSPLTTSQTLLFNILGGWVAAQLAAPGAATAFVGAGLAGAAIGSVGLGKVLIDILAGYGAGVAGALVAFKIMSGEVPSTEDLVNLLPAILSPGALVVGVVCAAILRRHVGPGEGAVQWMNRLIAFASRGNHVS

SEQ ID NO: 149 - DNA (cDNA), 1018 bp; single-stranded, linear
  CDS 1..1017
  misc_feature 70: /note= "A heterogeneity may exist - nucleotide 70 = G or C and  amino acid Xaa = Ala, Pro, Gly, or Arg"
  misc_feature 71: /note= "A heterogeneity may exist - nucleotide 71 = C or G and amino acid Xaa = Ala, Pro, Gly, or Arg"
  misc_feature 75: /note= "A heterogeneity may exist - nucleotide 75 = C or A and amino acid Xaa = His or Gln"
  misc_feature 140: /note= "A heterogeneity may exist - nucleotide 140 = C or G and amino acid Xaa = Ser or Cys"
  misc_feature 141: /note= "A heterogeneity may exist - nucleotide 141 = T or A and amino acid Xaa = Ser"
  misc_feature 162: /note= "A heterogeneity may exist - nucleotide 162 = C or T and amino acid Xaa = Leu"
  misc_feature 263: /note= "A heterogeneity may exist - nucleotide 263 = C or T and amino acid Xaa = Ala or Val"
  misc_feature 292: /note= "A heterogeneity may exist - nucleotide 292 = T or C and amino acid Xaa = Cys or Arg"
  misc_feature 309: /note= "A heterogeneity may exist - nucleotide 309 = C or G and amino acid Xaa = Arg"
  misc_feature 359: /note= "A heterogeneity may exist - nucleotide 359 = C or T and amino acid Xaa = Thr or Ile"
  misc_feature 411: /note= "A heterogeneity may exist - nucleotide 411= T or C and amino acid Xaa = Leu "
  misc_feature 419: /note= "A heterogeneity may exist - nucleotide 419 = G or A and amino acid Xaa = Ser or Asn"
  misc_feature 429: /note= "A heterogeneity may exist - nucleotide 429 = C or T and amino acid Xaa = Leu"
  misc_feature 521: /note= "A heterogeneity may exist - nucleotide 521 = A or C and amino acid Xaa = Gln or Pro"
  misc_feature 590: /note= "A heterogeneity may exist - nucleotide 590 = A or G and amino acid Xaa = Asn or Ser"
  misc_feature 615: /note= "A heterogeneity may exist - nucleotide 615 = A or G and amino acid Xaa = Val"
  misc_feature 619: /note= "A heterogeneity may exist - nucleotide 619 = G or A and amino acid Xaa = Ala, Thr, Gly, or Ser"
  misc_feature 620: /note= "A heterogeneity may exist - nucleotide 620 = C or G and amino acid Xaa = Ala, Thr, Gly, or Ser"
  misc_feature 700: /note= "A heterogeneity may exist - nucleotide 700 = T or G and amino acid Xaa = Phe or Val"
  misc_feature 764: /note= "A heterogeneity may exist - nucleotide 764 = C or G and amino acid Xaa = Ala or Gly"
  misc_feature 781: /note= "A heterogeneity exists - nucleotide 781 = G or C and amino acid Xaa = Gly or Arg"
  misc_feature 792: /note= "A heterogeneity exists - nucleotide 792 = C or T and amino acid Xaa = Ala"
  misc_feature 796: /note= "A heterogeneity exists - nucleotide 796 = C or A and amino acid Xaa = Arg or Ser"
  misc_feature 888: /note= "A heterogeneity may exist - nucleotide 888 = T or A and amino acid Xaa = Ser or Arg"
  misc_feature 889: /note= "A heterogeneity may exist - nucleotide 889 = A or T and amino acid Xaa = Thr or Ser"
  misc_feature 903: /note= "A heterogeneity may exist - nucleotide 903 = C or A and amino acid Xaa = Cys"
  misc_feature 933: /note= "A heterogeneity may exist - nucleotide 933 = G or A and amino acid Xaa = Ala "
  misc_feature 962: /note= "A heterogeneity may exist - nucleotide 962 = C or G and amino acid Xaa = Ser or Cys"
  misc_feature 965: /note= "A heterogeneity may exist - nucleotide 965 = C or A and amino acid Xaa = Ser"
  misc_feature 1002: /note= "A heterogeneity may exist - nucleotide 1002 = C or G and amino acid Xaa = Leu "
  original source individual isolate: Human 23
ggcttcgccgacctcatggggtacataccgctcgtcggcgcccctcttggaggccgtgccagggccctgssgcamggcgtccgggttttggaagacggcgtgaactatgcaacagggaaccttcctggttgctccttttswatcttccttctggccctactytcttgcctgaccgtgcccgcttcagcctaccaagtgcgcaactctacggggctttaccatgtcaccaatgattgccctaactcgagtattgtgtacgaggyggccgatgccatcctacacgctccggggygtgtcccttgcgttcgsgaggataacgtctcgagatgttgggtggcggtgacccccacggtggccaycaaggacggcaaactccccacaacgcagcttcgacgtcacatcgatctgctygtcgggarcgccaccctytgctcggccctctacgtgggggacctttgcgggtccatctttcttgtcggtcaactgtttaccttctctcccaggcgccactggacgacgcmggactgcaactgttctatctatcccggccatataacgggtcaccgcatggcatgggatatgatgatgarctggtcccctacggcggcattggtrgtarstcagctgctccggatcccacaagccatcttggacatgatcgctggtgctcactggggagtcctggcgggcatggcgtatktctccatggtggggaactgggcgaaggtcctggtagtgctgcttctatttgccggcgtcgacgsggaaacccaccgtaccsggggaagtgcygccmgcagcacggctggagttgctagtctcttcacaccaggcgctaggcagaacatccagctgatcaacaccaacggcagttggcacatcaatagwwcggccttgaactgmaatgacagccttaccaccggctggttagcrgggcttttctatcaccataaattcaactsttmaggctgtcccgagaggttggccagctgccgacccctsaccgattttgcccagg

SEQ ID NO: 150 - protein, 339 aa
GFADLMGYIPLVGAPLGGRARALXXGVRVLEDGVNYATGNLPGCSFXIFLLALXSCLTVPASAYQVRNSTGLYHVTNDCPNSSIVYEXADAILHAPGXVPCVXEDNVSRCWVAVTPTVAXKDGKLPTTQLRRHIDLXVGXATXCSALYVGDLCGSIFLVGQLFTFSPRRHWTTXDCNCSIYPGHITGHRMAWDMMMXWSPTAALXVXQLLRIPQAILDMIAGAHWGVLAGMAYXSMVGNWAKVLVVLLLFAGVDXETHRTXGSXAXSTAGVASLFTPGARQNIQLINTNGSWHINXXALNXNDSLTTGWLXGLFYHHKFNXXGCPERLASCRPXTDFAQ

SEQ ID NO: 151 - DNA (cDNA), 1018 bp; single-stranded, linear
  CDS 1..1017
  misc_feature 244: /note= "A heterogeneity may exist - nucleotide 244 = T or C and amino acid Xaa = Ser or Pro"
  misc_feature 256: /note= "A heterogeneity may exist - nucleotide 256 = T or C and amino acid Xaa = Tyr or His"
  misc_feature 311: /note= "A heterogeneity may exist - nucleotide 311 = A or G and amino acid Xaa = Glu or Gly"
  misc_feature 393: /note= "A heterogeneity may exist - nucleotide 393 = A or G and amino acid Xaa = Arg "
  misc_feature 404: /note= "A heterogeneity may exist - nucleotide 404 = A or G and amino acid Xaa = Asp or Gly"
  misc_feature 429: /note= "A heterogeneity may exist - nucleotide 429 = T or C and amino acid Xaa = Leu"
  misc_feature 471: /note= "A heterogeneity may exist - nucleotide 471 = T or C and amino acid Xaa = Phe"
  misc_feature 498: /note= "A heterogeneity may exist - nucleotide 498 = C or A and amino acid Xaa = Ser "
  misc_feature 606: /note= "A heterogeneity may exist - nucleotide 606 = A or G and amino acid Xaa = Ala "
  misc_feature 842: /note= "A heterogeneity may exist - nucleotide 842 = A or G and amino acid Xaa = Gln or Arg"
  misc_feature 867: /note= "A heterogeneity may exist - nucleotide 867 = C or T and amino acid Xaa = Asn "
  misc_feature 913: /note= "A heterogeneity may exist - nucleotide 913 = C or T and amino acid Xaa = Leu or Phe"
  misc_feature 930: /note= "A heterogeneity may exist - nucleotide 930 = A or G and amino acid Xaa = Val"
  misc_feature 1008: /note= "A heterogeneity may exist - nucleotide 1008 = T or C and amino acid Xaa = Asp"
  original source individual isolate: Human 27
ggcttcgccgacctcatggggtacattccgctcgtcggcgctcctcttgggggcgctgccagggccctggcgcatggcgtccgggttctggaagacggcgtgaactatgcaacagggaaccttcctggttgctctttctctatcttccttctggctctgctctcttgcctgaccgtgcccgcatcggcctaccaagtacgcaactcctcgggcatttaccatgtcaccaatgattgccctaatycgagtattgtgyacgagacggccgacaccatcctacactctccggggtgtgtcccttgcgttcgcgrgggtaacgcctcgaaatgttgggtgccggtagcccccacagtggccaccagggacggcaacctccccgcaacgcagcttcgrcgtcacatcgrtctgcttgtcgggagtgccaccctytgctcggccctctatgtgggggacttgtgcgggtctgtcttycttgtcggtcaactgttcactttctcmcccaggcgccactggacaacgcaagattgcaactgctctatctaccccggccatataacgggacaccgcatggcatgggatatgatgatgaactggtcccctacagcrgcgctggtaatggctcagctgctcaggatcccgcaagccatcttggacatgatcgctggtgctcactggggagtcctagcgggcatagcgtatttctccatggtggggaactgggcgaaggtcctggtggtgctgttgctgtttgccggcgtcgatgcgacaacctataccaccggggggaatgctgccaggaccacgcaggcgctcaccagttttttcagcccaggcgccaagcrggatatccagctgatcaacaccaayggcagttggcacatcaatcgcacggccttgaactgtaatgcgagcytcgacactggctgggtrgcggggctcttctattaccacaaattcaactcttcaggctgccccgagaggatggccagctgtaggccccttgccgayttcgaccagg

SEQ ID NO: 152 - protein, 339 aa
GFADLMGYIPLVGAPLGGAARALAHGVRVLEDGVNYATGNLPGCSFSIFLLALLSCLTVPASAYQVRNSSGIYHVTNDCPNXSIVXETADTILHSPGCVPCVRXGNASKCWVPVAPTVATRDGNLPATQLXRHIXLLVGSATXCSALYVGDLCGSVXLVGQLFTFXPRRHWTTQDCNCSIYPGHITGHRMAWDMMMNWSPTXALVMAQLLRIPQAILDMIAGAHWGVLAGIAYFSMVGNWAKVLVVLLLFAGVDATTYTTGGNAARTTQALTSFFSPGAKXDIQLINTXGSWHINRTALNCNASXDTGWXAGLFYYHKFNSSGCPERMASCRPLAXFDQ

SEQ ID NO: 153 - DNA (cDNA), 1019 bp; single-stranded, linear
  original source individual isolate: Human 27
cggcttcgccgacctcatggggtacattccgctcgtcggcgctcctcttgggggcgctgccagggccctggcgcatggcgtccgggttctggaagacggcgtgaactatgcaacagggaaccttcctggttgctctttctctatcttccttctggctctgctctcttgcctgaccgtgcccgcatcggcctaccaagtacgcaactcctcgggcatttaccatgtcaccaatgattgccctaattcgagtattgtgtacgagacggccgacaccatcctacactctccggggtgtgtcccttgcgttcgcgagggtaacgcctcgaaatgttgggtgccggtagcccccacagtggccaccagggacggcaacctccccgcaacgcagcttcgacgtcacatcgatctgcttgtcgggagtgccaccctttgctcggccctctatgtgggggacttgtgcgggtctgtctttcttgtcggtcaactgttcactttctcccccaggcgccactggacaacgcaagattgcaactgctctatctaccccggccatataacgggacaccgcatggcatgggatatgatgatgaactggtcccctacagcagcgctggtaatggctcagctgctcaggatcccgcaagccatcttggacatgatcgctggtgctcactggggagtcctagcgggcatagcgtatttctccatggtggggaactgggcgaaggtcctggtggtgctgttgctgtttgccggcgtcgatgcgacaacctataccaccggggggaatgctgccaggaccacgcaggcgctcaccagttttttcagcccaggcgccaagcaggatatccagctgatcaacaccaacggcagttggcacatcaatcgcacggccttgaactgtaatgcgagcctcgacactggctgggtagcggggctcttctattaccacaaattcaactcttcaggctgccccgagaggatggccagctgtaggccccttgccgatttcgaccagg

SEQ ID NO: 154 - DNA (cDNA), 1019 bp; single-stranded, linear
  original source individual isolate: HCV1
cggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcttgactgtgcccgcttcggcctaccaagtgcgcaactccacggggctttaccacgtcaccaatgattgccctaactcgagtattgtgtacgaggcggccgatgccatcctgcacactccggggtgcgtcccttgcgttcgtgagggcaacgcctcgaggtgttgggtggcgatgacccctacggtggccaccagggatggcaaactccccgcgacgcagcttcgacgtcacatcgatctgcttgtcgggagcgccaccctctgttcggccctctacgtgggggacctgtgcgggtctgtctttcttgtcggccaactgttcaccttctctcccaggcgccactggacgacgcaaggttgcaattgctctatctatcccggccatataacgggtcaccgcatggcatgggatatgatgatgaactggtcccctacgacggcgttggtaatggctcagctgctccggatcccacaagccatcttggacatgatcgctggtgctcactggggagtcctggcgggcatagcgtatttctccatggtggggaactgggcgaaggtcctggtagtgctgctgctatttgccggcgtcgacgcggaaacccacgtcaccgggggaagtgccggccacactgtgtctggatttgttagcctcctcgcaccaggcgccaagcagaacgtccagctgatcaacaccaacggcagttggcacctcaatagcacggccctgaactgcaatgatagcctcaacaccggctggttggcagggcttttctatcaccacaagttcaactcttcaggctgtcctgagaggctagccagctgccgaccccttaccgattttgaccagg

SEQ ID NO: 155 - DNA (cDNA), 1019 bp; single-stranded, linear
  original source individual isolate: Human 23
cggcttcgccgacctcatggggtacataccgctcgtcggcgcccctcttggaggccgtgccagggccctggcgcacggcgtccgggttttggaagacggcgtgaactatgcaacagggaaccttcctggttgctccttttctatcttccttctggccctactctcttgcctgaccgtgcccgcttcagcctaccaagtgcgcaactctacggggctttaccatgtcaccaatgattgccctaactcgagtattgtgtacgaggcggccgatgccatcctacacgctccggggtgtgtcccttgcgttcgcgaggataacgtctcgagatgttgggtggcggtgacccccacggtggccaccaaggacggcaaactccccacaacgcagcttcgacgtcacatcgatctgcttgtcgggagcgccaccctctgctcggccctctacgtgggggacctttgcgggtccatctttcttgtcggtcaactgtttaccttctctcccaggcgccactggacgacgcaggactgcaactgttctatctatcccggccatataacgggtcaccgcatggcatgggatatgatgatgaactggtcccctacggcggcattggtagtagctcagctgctccggatcccacaagccatcttggacatgatcgctggtgctcactggggagtcctggcgggcatggcgtatttctccatggtggggaactgggcgaaggtcctggtagtgctgcttctatttgccggcgtcgacgcggaaacccaccgtaccgggggaagtgccgcccgcagcacggctggagttgctagtctcttcacaccaggcgctaggcagaacatccagctgatcaacaccaacggcagttggcacatcaatagtacggccttgaactgcaatgacagccttaccaccggctggttagcggggcttttctatcaccataaattcaactcttcaggctgtcccgagaggttggccagctgccgacccctcaccgattttgcccagg

SEQ ID NO: 156 - protein, 339 aa
  original source individual isolate: Human 27
GFADLMGYIPLVGAPLGGAARALAHGVRVLEDGVNYATGNLPGCSFSIFLLALLSCLTVPASAYQVRNSSGIYHVTNDCPNSSIVYETADTILHSPGCVPCVREGNASKCWVPVAPTVATRDGNLPATQLRRHIDLLVGSATLCSALYVGDLCGSVFLVGQLFTFSPRRHWTTQDCNCSIYPGHITGHRMAWDMMMNWSPTAALVMAQLLRIPQAILDMIAGAHWGVLAGIAYFSMVGNWAKVLVVLLLFAGVDATTYTTGGNAARTTQALTSFFSPGAKQDIQLINTNGSWHINRTALNCNASLDTGWVAGLFYYHKFNSSGCPERMASCRPLADFDQ

SEQ ID NO: 157 - protein, 339 aa
  original source individual isolate: HCV1
GFADLMGYIPLVGAPLGGAARALAHGVRVLEDGVNYATGNLPGCSFSIFLLALLSCLTVPASAYQVRNSTGLYHVTNDCPNSSIVYEAADAILHTPGCVPCVREGNASRCWVAMTPTVATRDGKLPATQLRRHIDLLVGSATLCSALYVGDLCGSVFLVGQLFTFSPRRHWTTQGCNCSIYPGHITGHRMAWDMMMNWSPTTALVMAQLLRIPQAILDMIAGAHWGVLAGIAYFSMVGNWAKVLVVLLLFAGVDAETHVTGGSAGHTVSGFVSLLAPGAKQNVQLINTNGSWHLNSTALNCNDSLNTGWLAGLFYHHKFNSSGCPERLASCRPLTDFDQ

SEQ ID NO: 158 - protein, 339 aa
  original source individual isolate: Human 23
GFADLMGYIPLVGAPLGGRARALAHGVRVLEDGVNYATGNLPGCSFSIFLLALLSCLTVPASAYQVRNSTGLYHVTNDCPNSSIVYEAADAILHAPGCVPCVREDNVSRCWVAVTPTVATKDGKLPTTQLRRHIDLLVGSATLCSALYVGDLCGSIFLVGQLFTFSPRRHWTTQDCNCSIYPGHITGHRMAWDMMMNWSPTAALVVAQLLRIPQAILDMIAGAHWGVLAGMAYFSMVGNWAKVLVVLLLFAGVDAETHRTGGSAARSTAGVASLFTPGARQNIQLINTNGSWHINSTALNCNDSLTTGWLAGLFYHHKFNSSGCPERLASCRPLTDFAQ

SEQ ID NO: 159 - DNA (cDNA), 587 bp; single-stranded, linear
  original source individual isolate: Thorn
gaattcgcaatttgggtaaggtcatcgatacccttacgtgcggcttcgccgacctcatggggtacataccgctcgtcggcgcccctcttgggggcgctgccagggccctggcgcatggcgtccgggttctggaagacggcgtgaactatgcaacagggaaccttcctggttgctctttctctctcttccttctggccctgctctcttgtctgaccgtgcccgcttcagcctaccaagtgcgcaactccacggggctttaccatgtcaccaacgattgccccaactcgagtattgtgtacgaggcggccgatgctatcctgcacgctccggggtgtgtcccttgcgttcgcgagggtaacgcctcgaggtgttgggtggcgatgacccccacggtggccgccagggacggcagactccccacaacgcagctgcgacgtcacatcgatctgcttgtcgggagcgccaccctctgctcggccctctacgtgggggacctgtgcgggtccatctttcttgtcggtcaactgttcaccttctctcccaggcgccactggacgacgcaaggttgcaattgctctatcgaattc

SEQ ID NO: 160 - DNA (cDNA), 587 bp; single-stranded, linear
  original source individual isolate: EC1
gaattcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctttatcttccttctggccttgctctcttgcttgactgtgcccgcttcagcctaccaagtgcgcaactcctcggggctttaccatgtcaccaatgattgccctaactcgagcattgtgtacgaggcggccgatgccatcctgcacactccggggtgtgtcccttgcgttcacgagggcaacgtctcgaggtgttgggtggcgatgacccccacggtggccaccaggggcggcaaactccccacaacgcagcttcgacgtcacatcgatctgcttgtcgggagcgctaccctctgctcggccctctacgtgggggacctgtgcgggtctgtcttccttgtcggtcaactgtttaccttctctcccaggcgccactggacgacgcaaggttgcaattgctctatcgaattc

SEQ ID NO: 161 - DNA (cDNA), 585 bp; single-stranded, linear
  original source individual isolate: HCT18
gaattcgcaatttgggtaaggtcatcgatacccttacgtgcggcttcgccgacctcatggggtatataccgctcgtcggcgcccctcttggaggcgctgccagggccctggcgcatggcgtccgggttctggaagacggcgtgaactatgccagggaaccttcctggttgctctttctctatcttccttctggccctgctctcttgcctgactgtgcccgcttcagcccaccaagtgcgcaactccacggggctttaccatgtcaccaatgattgccccaactcgagtattgtatacgaagcggccgacgccatcctgcacactccggggtgtgtcccttgcgttcacgagggcaacgtctcgaggtgttgggtggcggtgacccccacggtggccaccagggatggcaaactccccacaacgcagcttcgacgtcacatcgatctgcttgtcgggagcgccaccctctgctcggccctctatgtgggggacttgtgcgggtctgtctttcttgtcggccaactgtttaccttctctcccaggcgccactggacgacgcaaggttgcaattgctctatcgaattc

SEQ ID NO: 162 - DNA (cDNA), 657 bp; single-stranded, linear
  original source individual isolate: HCV1
gggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcttgactgtgcccgcttcggcctaccaagtgcgcaactccacggggctttaccacgtcaccaatgattgccctaactcgagtattgtgtacgaggcggccgatgccatcctgcacactccggggtgcgtcccttgcgttcgtgagggcaacgcctcgaggtgttgggtggcgatgacccctacggtggccaccagggatggcaaactccccgcgacgcagcttcgacgtcacatcgatctgcttgtcgggagcgccaccctctgttcggccctctacgtgggggacctatgcgggtctgtctttcttgtcggccaactgttcaccttctctcccaggcgccactggacgacgcaaggttgcaattgctctatctatccc

SEQ ID NO: 163 - DNA (cDNA), 427 bp; single-stranded, linear
  original source individual isolate: EC10
  immediate source clone: clone 2
gaattcggacgacgcaaggttgcaattgctctatctatcccggccatataacaggtcaccgcatggcatgggatatgatgatgaactggtcccctacgacggcgttagtggtagctcagctgctcccgatcccacaagccatcttggacatgatcgctggtgctcactggggagtcctggcgggcatagcgtatttctccatggtggggaactgggcgaaggtcttggcagtgctgctgctatttgccggcgtcgacgcggaaacccacgtcactggggggatcgccgccaaaactacggctagccttactggtctcttcaatttaggtgccaagcagaacatccagctgatcaacaccaacggcagttggcacatcaacaggacggccttgaactgcaatgatagcctcaacaccggctggaattc

SEQ ID NO: 164 - DNA (cDNA), 480 bp; single-stranded, linear
  original source individual isolate: HCV1
ctctcccaggcgccactggacgacgcaaggttgcaattgctctatctatcccggccatataacgggtcaccgcatggcatgggatatgatgatgaactggtcccctacgacggcgttggtaatggctcagctgctccggatcccacaagccatcttggacatgatcgctggtgctcactggggagtcctggcgggcatagcgtatttctccatggtggggaactgggcgaaggtcctggtagtgctgctgctatttgccggcgtcgacgcggaaacccacgtcaccgggggaagtgccggccacactgtgtctggatttgttagcctcctcgcaccaggcgccaagcagaacgtccagctgatcaacaccaacggcagttggcacctcaatagcacggccctgaactgcaatgatagcctcaacaccggctggttggcagggcttttctatcaccacaagttcaactcttcaggctgtcc

SEQ ID NO: 165 - protein, 192 aa
  Duplication 115: /note= "There exists a heterogeneity at this position - Xaa = Tyr or His"
  original source individual isolate: HCT18
RNLGKVIDTLTCGFADLMGYIPPVGAPLGSAARALAHGVRVLEDGVNYATGNLPGCSFSIFLLALLSCLTVPASAHQVRNSTGLYHVTNDCPNSSIVYEAADAILHTPGCVPCVXEGNVSRCWVAVTPTVATRDGKLPTTQLRRHIDLLVGSATLCSALYVGDLCGSVFLVGQLFTFSPRRHWTTQGCNCSI

SEQ ID NO: 166 - protein, 192 aa
  original source individual isolate: JH23
RNLGKVIDTLTCGFADLMGYIPLVGAPLGSAARALAHGVRVLEDGVNYATGNLPGCSFSIFLLALLSCLTVPASAYQVRNSTGLYHVTNDCPNSSIVYEAADAILHAPGCVPCVREDNVSRCWVAVTPTVATKDGKLPTTQLRRHIDLLVGSATLCSALYVGDLCGSIFLVGQLFTFSPRRHWTTQDCNCSI

SEQ ID NO: 167 - protein, 192 aa
  original source individual isolate: JH27
RNLGKVIDTLTCGFADLMGYIPLVGAPLGSAARALAHGVRVLEDGVNYATGNLPGCSFSIFLLALLSCLTVPASAYQVRNSSGLYHVTNDCPNSSIVYETADTILHSPGCVPCVREGNASRCWVPVAPTVATRDGNLPATQLRRHIDLLVGSATLCSALYVGDLCGSVFLVGQLFTFSPRRHWTTQDCNCSI

SEQ ID NO: 168 - protein, 192 aa
  original source individual isolate: PBL-Th
RNLGKVIDTLTCGFADLMGYIPLVGAPLGSAARALAHGVRVLEDGVNYATGNLPGCSFSLFLLALLSCLTVPASAYQVRNSTGLYHVTNDCPNSSIVYEAADAILHAPGCVPCVREGNASRCWVAMTPTVAARDGRLPTTQLRRHIDLLVGSATLCSALYVGDLCGSVFLVGQLFTFSPRRHWTTQGCNCSI

SEQ ID NO: 169 - protein, 192 aa
  Duplication 59: /note= "There exists a heterogeneity at this position which can also be Phe."
  original source individual isolate: EC1
RNLGKVIDTLTCGFADLMGYIPLVGAPLGSAARALAHGVRVLEDGVNYATGNLPGCSFSIFLLALLSCLTVPASAYQVRNSSGLYHVTNDCPNSSIVYEAADAILHTPGCVPCVHEGNVSRCWVAMTPTVATRDGKLPTTQLRRHIDLLVGSATLCSALYVGDLCGSIFLVGQLFTFSPRRHWTTQGCNCSI

SEQ ID NO: 170 - protein, 192 aa
  original source individual isolate: HCV1 (chimpanzee)
RNLGKVIDTLTCGFADLMGYIPLVGAPLGSAARALAHGVRVLEDGVNYATGNLPGCSFSIFLLALLSCLTVPASAYQVRNSTGLYHVTNDCPNSSIVYEAADAILHTPGCVPCVREGNASRCWVAMTPTVATRDGKLPATQLRRHIDLLVGSATLCSALYVGDLCGSVFLVGQLFTFSPRRHWTTQGCNCSI

SEQ ID NO: 171 - protein, 139 aa
  original source individual isolate: JH23
TTQDCNCSIYPGHITGHRMAWDMMMNWSPTAALVVAQLLRIPQAILDMIAGAHWGVLAGMAYFSMVGNWAKVLVVLLLFAGVDAETHRTGGSAARSTAGVASLFSPGARQNIQLINTNGSWHINSTALNCNDSLTTGWV

SEQ ID NO: 172 - protein, 139 aa
  original source individual isolate: JH27
TTQDCNCSIYPGHITGHRMAWDMMMNWSPTAALVMAQLLRIPQAILDMIAGAHWGVLAGIAYFSMVGNWAKVLVVLLLFAGVDATTYTTGGNAARTTQALTSFFTPGAKQDIQLINTNGSWHINRTALNCNASLDTGWL

SEQ ID NO: 173 - protein, 139 aa
  original source individual isolate: Japanese isolate (T. Miyamura)
TTQGCNCSIYPGHITGHRMAWDMMMNWSPTTALVVSQLLRIPQAVMDMVAGAHWGVLAGLAYYSMVGNWAKVLIVMLLFAGVDGHTRVTGGVQGHVTSTLTSLFRPGASQKIQLVNTNGSWHINRTALNCNDSLQTGFL

SEQ ID NO: 174 - protein, 139 aa
  original source individual isolate: EC10 (Italy)
TTQGCNCSIYPGHITGHRMAWDMMMNWSPTTALVMAQLLRIPQAILDMIAGAHWGVLAGIAYFSMVGNWAKVLAVLLLFAGVDAETHVTGGIAAKTTASLTALFNLGAKQNIQLINTNGSWHINRTALNCNDSLNTGWN

SEQ ID NO: 175 - protein, 139 aa
  original source individual isolate: HCV1 (chimpanzee)
TTQGCNCSIYPGHITGHRMAWDMMMNWSPTTALVMAQLLRIPQAILDMIAGAHWGVLAGIAYFSMVGNWAKVLVVLLLFAGVDAETHVTGGSAGHTVSGFVSLLAPGAKQNVQLINTNGSWHLNSTALNCNDSLNTGWL

SEQ ID NO: 176 - DNA (cDNA), 9379 bp; single-stranded, linear
  misc_feature 345: /note= "A heterogeneity may exist at this position which is A or G"
  misc_feature 351: /note= "A heterogeneity may exist at this position which is A or C"
  misc_feature 846: /note= "A heterogeneity may exist at this position which is T or C"
  misc_feature 1319: /note= "A heterogeneity may exist at this position which is A or G"
  misc_feature 2126: /note= "A heterogeneity may exist at this position which is A or C"
  misc_feature 3659: /note= "A heterogeneity may exist at this position which is C or T"
  misc_feature 3669: /note= "A heterogeneity may exist at this position which is G or C"
  misc_feature 4146: /note= "A heterogeneity may exist at this position which is C or T"
  misc_feature 4680: /note= "A heterogeneity may exist at this position which is G or A"
  misc_feature 9080: /note= "A heterogeneity may exist at this position which is A or G"
cactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaaraaaaamcaaacgtaacaccaaccgtcgcccacaggacgtcaagttcccgggtggcggtcagatcgttggtggagtttacttgttgccgcgcaggggccctagattgggtgtgcgcgcgacgagaaagacttccgagcggtcgcaacctcgaggtagacgtcagcctatccccaaggctcgtcggcccgagggcaggacctgggctcagcccgggtacccttggcccctctatggcaatgagggctgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaagcgctgccagggccctggcgcatggcgtccgggttctggaagacggcgtgaactatgcaacagggaaccttcctggttgctctttctctaycttccttctggccctgctctcttgcttgactgtgcccgcttcggcctaccaagtgcgcaactccacggggctttaccacgtcaccaatgattgccctaactcgagtattgtgtacgaggcggccgatgccatcctgcacactccggggtgcgtcccttgcgttcgtgagggcaacgcctcgaggtgttgggtggcgatgacccctacggtggccaccagggatggcaaactccccgcgacgcagcttcgacgtcacatcgatctgcttgtcgggagcgccaccctctgttcggccctctacgtgggggacctatgcgggtctgtctttcttgtcggccaactgttcaccttctctcccaggcgccactggacgacgcaaggttgcaattgctctatctatcccggccatataacgggtcaccgcatggcatgggatatgatgatgaactggtcccctacgacggcgttggtartggctcagctgctccggatcccacaagccatcttggacatgatcgctggtgctcactggggagtcctggcgggcatagcgtatttctccatggtggggaactgggcgaaggtcctggtagtgctgctgctatttgccggcgtcgacgcggaaacccacgtcaccgggggaagtgccggccacactgtgtctggatttgttagcctcctcgcaccaggcgccaagcagaacgtccagctgatcaacaccaacggcagttggcacctcaatagcacggccctgaactgcaatgatagcctcaacaccggctggttggcagggcttttctatcaccacaagttcaactcttcaggctgtcctgagaggctagccagctgccgaccccttaccgattttgaccagggctggggccctatcagttatgccaacggaagcggccccgaccagcgcccctactgctggcactaccccccaaaaccttgcggtattgtgcccgcgaagagtgtgtgtggtccggtatattgcttcactcccagccccgtggtggtgggaacgaccgacaggtccggcgcgcccacctacagctggggtgaaaatgatacggacgtcttcgtccttaacaataccaggccaccgctgggcaattggttcggttgtacctggatgaactcaactggattcaccaaagtgtgcggagcgcctccttgtgtcatcggaggggcgggcaacaacaccctgcactgccccactgattgcttccgcaagcatccggacgccacatactctcggtgcggctccggtccctggmtcacacccaggtgcctggtcgactacccgtataggctttggcattatccttgtaccatcaactacaccatatttaaaatcaggatgtacgtgggaggggtcgaacacaggctggaagctgcctgcaactggacgcggggcgaacgttgcgatctggaagacagggacaggtccgagctcagcccgttactgctgaccactacacagtggcaggtcctcccgtgttccttcacaaccctaccagccttgtccaccggcctcatccacctccaccagaacattgtggacgtgcagtacttgtacggggtggggtcaagcatcgcgtcctgggccattaagtgggagtacgtcgttctcctgttccttctgcttgcagacgcgcgcgtctgctcctgcttgtggatgatgctactcatatcccaagcggaggcggctttggagaacctcgtaatacttaatgcagcatccctggccgggacgcacggtcttgtatccttcctcgtgttcttctgctttgcatggtatttgaagggtaagtgggtgcccggagcggtctacaccttctacgggatgtggcctctcctcctgctcctgttggcgttgccccagcgggcgtacgcgctggacacggaggtggccgcgtcgtgtggcggtgttgttctcgtcgggttgatggcgctgactctgtcaccatattacaagcgctatatcagctggtgcttgtggtggcttcagtattttctgaccagagtggaagcgcaactgcacgtgtggattccccccctcaacgtccgaggggggcgcgacgccgtcatcttactcatgtgtgctgtacacccgactctggtatttgacatcaccaaattgctgctggccgtcttcggacccctttggattcttcaagccagtttgcttaaagtaccctactttgtgcgcgtccaaggccttctccggttctgcgcgttagcgcggaagatgatcggaggccattacgtgcaaatggtcatcattaagttaggggcgcttactggcacctatgtttataaccatctcactcctcttcgggactgggcgcacaacggcttgcgagatctggccgtggctgtagagccagtcgtcttctcccaaatggagaccaagctcatcacgtggggggcagataccgccgcgtgcggtgacatcatcaacggcttgcctgtttccgcccgcaggggccgggagatactgctcgggccagccgatggaatggtctccaaggggtggaggttgctggcgcccatcacggcgtacgcccagcagacaaggggcctcctagggtgcataatcaccagcctaactggccgggacaaaaaccaagtggagggtgaggtccagattgtgtcaactgctgcccaaaccttcctggcaacgtgcatcaatggggtgtgctggactgtctaccacggggccggaacgaggaccatcgcgtcacccaagggtcctgtcatccagatgtataccaatgtagaccaagaccttgtgggctggcccgctycgcaaggtasccgctcattgacaccctgcacttgcggctcctcggacctttacctggtcacgaggcacgccgatgtcattcccgtgcgccggcggggtgatagcaggggcagcctgctgtcgccccggcccatttcctacttgaaaggctcctcggggggtccgctgttgtgccccgcggggcacgccgtgggcatatttagggccgcggtgtgcacccgtggagtggctaaggcggtggactttatccctgtggagaacctagagacaaccatgaggtccccggtgttcacggataactcctctccaccagtagtgccccagagcttccaggtggctcacctccatgctcccacaggcagcggcaaaagcaccaaggtcccggctgcatatgcagctcagggctataaggtgctagtactcaacccctctgttgctgcaacactgggctttggtgcttacatgtccaaggctcatgggatcgatcytaacatcaggaccggggtgagaacaattaccactggcagccccatcacgtactccacctacggcaagttccttgccgacggcgggtgctcggggggcgcttatgacataataatttgtgacgagtgccactccacggatgccacatccatcttgggcatcggcactgtccttgaccaagcagagactgcgggggcgagactggttgtgctcgccaccgccacccctccgggctccgtcactgtgccccatcccaacatcgaggaggttgctctgtccaccaccggagagatccctttttacggcaaggctatccccctcgaagtaatcaagggggggagacatctcatcttctgtcattcaaagaagaagtgcgacgaactcgccgcaaagctggtcgcattgggcatcaatgccgtggcctactaccgcggtcttgacgtgtccgtcatcccgaccagcggcgatgttgtcgtcgtggcaaccgatgccctcatgaccggctataccggcgacttcgactcggtgatagactrcaatacgtgtgtcacccagacagtcgatttcagccttgaccctaccttcaccattgagacaatcacgctcccccaggatgctgtctcccgcactcaacgtcggggcaggactggcagggggaagccaggcatcaacagatttgtggcaccgggggagcgcccctccggcatgttcgactcgtccgtcctctgtgagtgctatgacgcaggctgtgcttggtatgagctcacgcccgccgagactacagttaggctacgagcgtacatgaacaccccggggcttcccgtgtgccaggaccatcttgaattttgggagggcgtctttacaggcctcactcatatagatgcccactttctatcccagacaaagcagagtggggagaaccttccttacctggtagcgtaccaagccaccgtgtgcgctagggctcaagcccctcccccatcgtgggaccagatgtggaagtgtttgattcgcctcaagcccaccctccatgggccaacacccctgctatacagactgggcgctgttcagaatgaaatcaccctgacgcacccagtcaccaaatacatcatgacatgcatgtcggccgacctggaggtcgtcacgagcacctgggtgctcgttggcggcgtcctggctgctttggccgcgtattgcctgtcaacaggctgcgtggtcatagtgggcagggtcgtcttgtccgggaagccggcaatcatacctgacagggaagtcctctaccgagagttcgatgagatggaagagtgctctcagcacttaccgtacatcgagcaagggatgatgctcgccgagcagttcaagcagaaggccctcggcctcctgcagaccgcgtcccgtcaggcagaggttatcgcccctgctgtccagaccaactggcaaaaactcgagaccttctgggcgaagcatatgtggaacttcatcagtgggatacaatacttggcgggcttgtcaacgctgcctggtaaccccgccattgcttcattgatggcttttacagctgctgtcaccagcccactaaccactagccaaaccctcctcttcaacatattgggggggtgggtggctgcccagctcgccgcccccggtgccgctactgcctttgtgggcgctggcttagctggcgccgccatcggcagtgttggactggggaaggtcctcatagacatccttgcagggtatggcgcgggcgtggcgggagctcttgtggcattcaagatcatgagcggtgaggtcccctccacggaggacctggtcaatctactgcccgccatcctctcgcccggagccctcgtagtcggcgtggtctgtgcagcaatactgcgccggcacgttggcccgggcgagggggcagtgcagtggatgaaccggctgatagccttcgcctcccgggggaaccatgtttcccccacgcactacgtgccggagagcgatgcagctgcccgcgtcactgccatactcagcagcctcactgtaacccagctcctgaggcgactgcaccagtggataagctcggagtgtaccactccatgctccggttcctggctaagggacatctgggactggatatgcgaggtgttgagcgactttaagacctggctaaaagctaagctcatgccacagctgcctgggatcccctttgtgtcctgccagcgcgggtataagggggtctggcgagtggacggcatcatgcacactcgctgccactgtggagctgagatcactggacatgtcaaaaacgggacgatgaggatcgtcggtcctaggacctgcaggaacatgtggagtgggaccttccccattaatgcctacaccacgggcccctgtaccccccttcctgcgccgaactacacgttcgcgctatggagggtgtctgcagaggaatatgtggagataaggcaggtgggggacttccactacgtgacgggtatgactactgacaatctcaaatgcccgtgccaggtcccatcgcccgaatttttcacagaattggacggggtgcgcctacataggtttgcgcccccctgcaagcccttgctgcgggaggaggtatcattcagagtaggactccacgaatacccggtagggtcgcaattaccttgcgagcccgaaccggacgtggccgtgttgacgtccatgctcactgatccctcccatataacagcagaggcggccgggcgaaggttggcgaggggatcacccccctctgtggccagctcctcggctagccagctatccgctccatctctcaaggcaacttgcaccgctaaccatgactcccctgatgctgagctcatagaggccaacctcctatggaggcaggagatgggcggcaacatcaccagggttgagtcagaaaacaaagtggtgattctggactccttcgatccgcttgtggcggaggaggacgagcgggagatctccgtacccgcagaaatcctgcggaagtctcggagattcgcccaggccctgcccgtttgggcgcggccggactataaccccccgctagtggagacgtggaaaaagcccgactacgaaccacctgtggtccatggctgtccgcttccacctccaaagtcccctcctgtgcctccgcctcggaagaagcggacggtggtcctcactgaatcaaccctatctactgccttggccgagctcgccaccagaagctttggcagctcctcaacttccggcattacgggcgacaatacgacaacatcctctgagcccgccccttctggctgcccccccgactccgacgctgagtcctattcctccatgccccccctggagggggagcctggggatccggatcttagcgacgggtcatggtcaacggtcagtagtgaggccaacgcggaggatgtcgtgtgctgctcaatgtcttactcttggacaggcgcactcgtcaccccgtgcgccgcggaagaacagaaactgcccatcaatgcactaagcaactcgttgctacgtcaccacaatttggtgtattccaccacctcacgcagtgcttgccaaaggcagaagaaagtcacatttgacagactgcaagttctggacagccattaccaggacgtactcaaggaggttaaagcagcggcgtcaaaagtgaaggctaacttgctatccgtagaggaagcttgcagcctgacgcccccacactcagccaaatccaagtttggttatggggcaaaagacgtccgttgccatgccagaaaggccgtaacccacatcaactccgtgtggaaagaccttctggaagacaatgtaacaccaatagacactaccatcatggctaagaacgaggttttctgcgttcagcctgagaaggggggtcgtaagccagctcgtctcatcgtgttccccgatctgggcgtgcgcgtgtgcgaaaagatggctttgtacgacgtggttacaaagctccccttggccgtgatgggaagctcctacggattccaatactcaccaggacagcgggttgaattcctcgtgcaagcgtggaagtccaagaaaaccccaatggggttctcgtatgatacccgctgctttgactccacagtcactgagagcgacatccgtacggaggaggcaatctaccaatgttgtgacctcgacccccaagcccgcgtggccatcaagtccctcaccgagaggctttatgttgggggccctcttaccaattcaaggggggagaactgcggctatcgcaggtgccgcgcgagcggcgtactgacaactagctgtggtaacaccctcacttgctacatcaaggcccgggcagcctgtcgagccgcagggctccaggactgcaccatgctcgtgtgtggcgacgacttagtcgttatctgtgaaagcgcgggggtccaggaggacgcggcgagcctgagagccttcacggaggctatgaccaggtactccgccccccctggggaccccccacaaccagaatacgacttggagctcataacatcatgctcctccaacgtgtcagtcgcccacgacggcgctggaaagagggtctactacctcacccgtgaccctacaacccccctcgcgagagctgcgtgggagacagcaagacacactccagtcaattcctggctaggcaacataatcatgtttgcccccacactgtgggcgaggatgatactgatgacccatttctttagcgtccttatagccagggaccagcttgaacaggccctcgattgcgagatctacggggcctgctactccatagaaccacttgatctacctccaatcattcaaagactccatggcctcagcgcattttcactccacagttactctccaggtgaaattaatagggtggccgcatgcctcagaaaacttggggtaccgcccttgcgagcttggrgacaccgggcccggagcgtccgcgctaggcttctggccagaggaggcagggctgccatatgtggcaagtacctcttcaactgggcagtaagaacaaagctcaaactcactccaatagcggccgctggccagctggacttgtccggctggttcacggctggctacagcgggggagacatttatcacagcgtgtctcatgcccggccccgctggatctggttttgcctactcctgcttgctgcaggggtaggcatctacctcctccccaaccgatgaaggttggggtaaacactccggcct

SEQ ID NO: 177 - protein, 3011 aa
  Duplication 9: /note= "There exists a heterogeneity at this position - Xaa = Lys or Arg"
  Duplication 11: /note= "There  exists a heterogeneity at this position - Xaa = Asn or Thr"
  Duplication 176: /note= "There exists a heterogeneity at this position - Xaa = Ile or Thr"
  Duplication 334: /note= "There exists a heterogeneity at this position - Xaa = Met or Val"
  Duplication 603: /note= "There exists a heterogeneity at this position - Xaa = Leu or Ile"
  Duplication 848: /note= "There exists a heterogeneity at this position - Xaa = Tyr or  Asn"
  Duplication 1114: /note= "There exists a heterogeneity at this position - Xaa = Pro or Ser"
  Duplication 1117: /note= "There exists a heterogeneity at this position - Xaa = Ser or Thr"
  Duplication 1276: /note= "There exists a heterogeneity at this position - Xaa = Pro or Leu"
  Duplication 1454: /note= "There exists a heterogeneity at this position - Xaa = Cys or Tyr"
  Duplication 1471: /note= "There exists a heterogeneity at this position - Xaa = Thr or  Ser"
  Duplication 1877: /note= "There exists a heterogeneity at this position - Xaa = Glu or Gly"
  Duplication 1948: /note= "There exists a heterogeneity at this position - Xaa = Leu or His"
  Duplication 1949: /note= "There exists a heterogeneity at this position - Xaa = Ser or Cys"
  Duplication 2021: /note= "There exists a heterogeneity at this position - Xaa = Gly or Val"
  Duplication 2349: /note= "There exists a heterogeneity at this position - Xaa = Thr or Ser"
  Duplication 2385: /note= "There exists a heterogeneity at this position - Xaa = Tyr or  Phe"
  Duplication 2386: /note= "There exists a heterogeneity at this position - Xaa = Ser or  Ala"
  Duplication 2502: /note= "There exists a heterogeneity at this position - Xaa = Leu or Phe"
  Duplication 2690: /note= "There exists a heterogeneity at this position - Xaa = Arg or  Gly"
  Duplication 2921: /note= "There exists a heterogeneity at this position - Xaa = Arg or  Gly"
  Duplication 2996: /note= "There exists a heterogeneity at this position - Xaa = Leu or  Pro"
MSTNPKPQXKXKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGSAARALAHGVRVLEDGVNYATGNLPGCSFSXFLLALLSCLTVPASAYQVRNSTGLYHVTNDCPNSSIVYEAADAILHTPGCVPCVREGNASRCWVAMTPTVATRDGKLPATQLRRHIDLLVGSATLCSALYVGDLCGSVFLVGQLFTFSPRRHWTTQGCNCSIYPGHITGHRMAWDMMMNWSPTTALVXAQLLRIPQAILDMIAGAHWGVLAGIAYFSMVGNWAKVLVVLLLFAGVDAETHVTGGSAGHTVSGFVSLLAPGAKQNVQLINTNGSWHLNSTALNCNDSLNTGWLAGLFYHHKFNSSGCPERLASCRPLTDFDQGWGPISYANGSGPDQRPYCWHYPPKPCGIVPAKSVCGPVYCFTPSPVVVGTTDRSGAPTYSWGENDTDVFVLNNTRPPLGNWFGCTWMNSTGFTKVCGAPPCVIGGAGNNTLHCPTDCFRKHPDATYSRCGSGPWXTPRCLVDYPYRLWHYPCTINYTIFKIRMYVGGVEHRLEAACNWTRGERCDLEDRDRSELSPLLLTTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGKWVPGAVYTFYGMWPLLLLLLALPQRAYALDTEVAASCGGVVLVGLMALTLSPYYKRYISWCLWWLQXFLTRVEAQLHVWIPPLNVRGGRDAVILLMCAVHPTLVFDITKLLLAVFGPLWILQASLLKVPYFVRVQGLLRFCALARKMIGGHYVQMVIIKLGALTGTYVYNHLTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAXQGXRSLTPCTCGSSDLYLVTRHADVIPVRRRGDSRGSLLSPRPISYLKGSSGGPLLCPAGHAVGIFRAAVCTRGVAKAVDFIPVENLETTMRSPVFTDNSSPPVVPQSFQVAHLHAPTGSGKSTKVPAAYAAQGYKVLVLNPSVAATLGFGAYMSKAHGIDXNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGYTGDFDSVIDXNTCVTQTVDFSLDPTFXIETITLPQDAVSRTQRRGRTGRGKPGINRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEITLTHPVTKYIMTCMSADLEVVTSTWVLVGGVLAALAAYCLSTGCVVIVGRVVLSGKPAIIPDREVLYREFDEMEECSQHLPYIEQGMMLAEQFKQKALGLLQTASRQAEVIAPAVQTNWQKLETFWAKHMWNFISGIQYLAGLSTLPGNPAIASLMAFTAAVTSPLTTSQTLLFNILGGWVAAQLAAPGAATAFVGAGLAGAAIGSVGLGKVLIDILAGYGAGVAGALVAFKIMSGEVPSTXDLVNLLPAILSPGALVVGVVCAAILRRHVGPGEGAVQWMNRLIAFASRGNHVSPTHYVPESDAAARVTAIXXSLTVTQLLRRLHQWISSECTTPCSGSWLRDIWDWICEVLSDFKTWLKAKLMPQLPGIPFVSCQRGYKGVWRXDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGGNITRVESENKVVILDSFDPLVAEEDEREISVPAEILRKSRRFAQALPVWARPDYNPPLVETWKKPDYEPPVVHGCPLPPPKSPPVPPPRKKRTVVLTESTLSTALAELAXRSFGSSSTSGITGDNTTTSSEPAPSGCPPDSDAESXXSMPPLEGEPGDPDLSDGSWSTVSSEANAEDVVCCSMSYSWTGALVTPCAAEEQKLPINALSNSLLRHHNLVYSTTSRSACQRQKKVTFDRLQVLDSHYQDVLKEVKAAASKVKANXLSVEEACSLTPPHSAKSKFGYGAKDVRCHARKAVTHINSVWKDLLEDNVTPIDTTIMAKNEVFCVQPEKGGRKPARLIVFPDLGVRVCEKMALYDVVTKLPLAVMGSSYGFQYSPGQRVEFLVQAWKSKKTPMGFSYDTRCFDSTVTESDIRTEEAIYQCCDLDPQARVAIKSLTERLYVGGPLTNSXGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWXHRARSVRARLLARGGRAAICGKYLFNWAVRTKLKLTPIAAAGQLDLSGWFTAGYSGGDIYHSVSHARPRWIWFCXLLLAAGVGIYLLPNR

SEQ ID NO: 178 - DNA (other nucleic acid), 80 bp; single-stranded, linear
  description: /desc = "synthetic polynucleotide probe"
tcccttgctcgatgtacggtaagtgctgagagcactcttccatctcatcgaactctcggtagaggacttccctgtcaggt

SEQ ID NO: 179 - DNA (other nucleic acid), 30 bp; single-stranded, linear
  description: /desc = "synthetic polynucleotide probe"
ctgtcaggtatgattgccggcttcccggac

SEQ ID NO: 180 - DNA (other nucleic acid), 30 bp; single-stranded, linear
  description: /desc = "synthetic polynucleotide probe"
tttggctagtggttagtgggctggtgacag

SEQ ID NO: 181 - DNA (other nucleic acid), 30 bp; single-stranded, linear
  description: /desc = "synthetic polynucleotide probe"
aagccaccgtgtgcgctagggctcaagccc

SEQ ID NO: 182 - DNA (other nucleic acid), 27 bp; single-stranded, linear
  description: /desc = "synthetic polynucleotide probe"
caggatgctgtctcccgcactcaacgt

SEQ ID NO: 183 - DNA (other nucleic acid), 30 bp; single-stranded, linear
  description: /desc = "synthetic hybridization probe"
agtgcagtggatgaaccggctgatagcctt

SEQ ID NO: 184 - DNA (other nucleic acid), 30 bp; single-stranded, linear
  description: /desc = "synthetic polynucleotide probe"
tcctgaggcgactgcaccagtggataagct

SEQ ID NO: 185 - DNA (other nucleic acid), 28 bp; single-stranded, linear
  description: /desc = "synthetic polynucleotide probe"
caggatgctgtctcccgcactcaacgtc

SEQ ID NO: 186 - DNA (other nucleic acid), 30 bp; single-stranded, linear; identical to SEQ ID NO: 184
  description: /desc = "synthetic polynucleotide probe"

SEQ ID NO: 187 - DNA (other nucleic acid), 30 bp; single-stranded, linear
  description: /desc = "hybridization probe for isolation of clone 33c"
atcaggaccggggtgagaacaattaccact

SEQ ID NO: 188 - DNA (other nucleic acid), 28 bp; single-stranded, linear
  description: /desc = "probe for isolation of clone 8h."
agagacaaccatgaggtccccggtgttc

SEQ ID NO: 189 - DNA (other nucleic acid), 27 bp; single-stranded, linear
  description: /desc = "probe for isolation of clone 7e."
tcggacctttacctggtcacgaggcac

SEQ ID NO: 190 - DNA (other nucleic acid), 30 bp; single-stranded, linear
  description: /desc = "probe for isolation of clone 14c."
accttccccattaatgcctacaccacgggc

SEQ ID NO: 191 - DNA (other nucleic acid), 30 bp; single-stranded, linear
  description: /desc = "probe for isolation of clone 8f."
tccatctctcaaggcaacttgcaccgctaa

SEQ ID NO: 192 - DNA (other nucleic acid), 30 bp; single-stranded, linear
  description: /desc = "probe for isolation of clone 33f."
tccatggctgtccgcttccacctccaaagt

SEQ ID NO: 193 - DNA (other nucleic acid), 30 bp; single-stranded, linear
  description: /desc = "probe for isolation of clone 33g."
gcgacaatacgacaacatcctctgagcccg

SEQ ID NO: 194 - DNA (other nucleic acid), 31 bp; single-stranded, linear
  description: /desc = "probe for isolation of clone 7f."
agcagacaaggggcctcctagggtgcataat

SEQ ID NO: 195 - DNA (other nucleic acid), 30 bp; single-stranded, linear
  description: /desc = "probe for isolation of clone 11b."
cacctatgtttataaccatctcactcctct

SEQ ID NO: 196 - DNA (other nucleic acid), 30 bp; single-stranded, linear
  description: /desc = "probe for isolation of clone 14i."
ctctgtcaccatattacaagcgctatatca

SEQ ID NO: 197 - DNA (other nucleic acid), 30 bp; single-stranded, linear
  description: /desc = "probe for isolation of clone 39c."
ctcgttgctacgtcaccacaatttggtgta

SEQ ID NO: 198 - DNA (other nucleic acid), 30 bp; single-stranded, linear
  description: /desc = "hybridization probe used in isolation of clone 12f."
tgcttgtggatgatgctactcatatcccaa

SEQ ID NO: 199 - DNA (other nucleic acid), 30 bp; single-stranded, linear
  description: /desc = "hybridization probe for isolation of clone 35f."
agcagcggcgtcaaaagtgaaggctaactt

SEQ ID NO: 200 - DNA (other nucleic acid), 30 bp; single-stranded, linear
  description: /desc = "hybridization probe for isolation of clone 19g."
ttctcgtatgatacccgctgctttgactcc

SEQ ID NO: 201 - DNA (other nucleic acid), 30 bp; single-stranded, linear
  description: /desc = "hybridization probe for isolation of clone 26g."
tgtgtggcgacgacttagtcgttatctgtg

SEQ ID NO: 202 - DNA (other nucleic acid), 30 bp; single-stranded, linear
  description: /desc = "hybridization probe for isolation of clone 15e."
cacactccagtcaattcctggctaggcaac

SEQ ID NO: 203 - DNA (other nucleic acid), 15 bp; single-stranded, linear
  description: /desc = "primer based on clone 11b."
ctggcttgaagaatc

SEQ ID NO: 204 - DNA (other nucleic acid), 20 bp; single-stranded, linear
  description: /desc = "primer based on clone 7e."
agttaggctggtgattatgc

SEQ ID NO: 205 - DNA (other nucleic acid), 30 bp; single-stranded, linear
  description: /desc = "synthetic polynucleotide probe for isolation of clone 13i."
gaacgttgcgatctggaagacagggacagg

SEQ ID NO: 206 - DNA (other nucleic acid), 30 bp; single-stranded, linear
  description: /desc = "probe for the isolation of clone 26j."
tatcagttatgccaacggaagcggccccga

SEQ ID NO: 207 - DNA (other nucleic acid), 30 bp; single-stranded, linear
  description: /desc = "probe for the isolation of clone CA59a."
ctggttagcagggcttttctatcaccacaa

SEQ ID NO: 208 - DNA (other nucleic acid), 30 bp; single-stranded, linear
  description: /desc = "probe for isolation of clone CA84a."
aaggtcctggtagtgctgctgctatttgcc

SEQ ID NO: 209 - DNA (other nucleic acid), 30 bp; single-stranded, linear
  description: /desc = "probe used for isolation of clone CA156e."
actggacgacgcaaggttgcaattgctcta

SEQ ID NO: 210 - DNA (other nucleic acid), 30 bp; single-stranded, linear
  description: /desc = "probe used for isolation of clone CA167b."
ttcgacgtcacatcgatctgcttgtcggga

SEQ ID NO: 211 - DNA (other nucleic acid), 15 bp; single-stranded, linear
  description: /desc = "primer"
ggtgacgtgggtttc

SEQ ID NO: 212 - DNA (other nucleic acid), 30 bp; single-stranded, linear
  description: /desc = "synthetic polynucleotide probe"
ggctttaccacgtcaccaatgattgcccta

SEQ ID NO: 213 - DNA (other nucleic acid), 30 bp; single-stranded, linear
  description: /desc = "synthetic polynucleotide probe"
tttgggtaaggtcatcgatacccttacgtg

SEQ ID NO: 214 - DNA (other nucleic acid), 15 bp; single-stranded, linear
  description: /desc = "primer"
gaagccgcacgtaag

SEQ ID NO: 215 - DNA (other nucleic acid), 27 bp; single-stranded, linear
  description: /desc = "synthetic polynucleotide probe."
ccggcgtaggtcgcgcaatttgggtaa

SEQ ID NO: 216 - DNA (other nucleic acid), 30 bp; single-stranded, linear
  description: /desc = "synthetic probe used for isolation of clone CA205a."
tcagatcgttggtggagtttacttgttgcc

SEQ ID NO: 217 - DNA (other nucleic acid), 30 bp; single-stranded, linear
  description: /desc = "synthetic polynucleotide probe used for isolation of clone 18g."
ccatagtggtctgcggaaccggtgagtaca

SEQ ID NO: 218 - DNA (other nucleic acid), 30 bp; single-stranded, linear
  description: /desc = "synthetic probe used for isolation of clone b5a."
attgcgagatctacggggcctgctactcca

SEQ ID NO: 219 - DNA (other nucleic acid), 54 bp; single-stranded, linear
  description: /desc = "oligo dT-primer adapter"
aattcgcggccgccatacgatttaggtgacactatagaattttttttttttttt

SEQ ID NO: 220 - DNA (other nucleic acid), 30 bp; single-stranded, linear
  description: /desc = "primer JH32"
atagcggccgccctcgattgcgagatctac

SEQ ID NO: 221 - DNA (other nucleic acid), 22 bp; single-stranded, linear
  description: /desc = "primer JH11"
aattcgggcggccgccatacga

SEQ ID NO: 222 - DNA (other nucleic acid), 30 bp; single-stranded, linear
  description: /desc = "polynucleotide probe JH34"
cttgatctacctccaatcattcaaagactc

SEQ ID NO: 223 - DNA (other nucleic acid), 30 bp; single-stranded, linear
  description: /desc = "synthetic probe used for isolation of clone 6k."
tcttcaactgggcagtaagaacaaagctca

SEQ ID NO: 224 - DNA (other nucleic acid), 54 bp; single-stranded, linear; identical to SEQ ID NO: 219
  description: /desc = "dT-primer adapter"

SEQ ID NO: 225 - DNA (other nucleic acid), 28 bp; single-stranded, linear
  description: /desc = "primer"
ttcgcggccgctacagcgggggagacat

SEQ ID NO: 226 - DNA (other nucleic acid), 20 bp; single-stranded, linear
  description: /desc = "primer"
aattcgcggccgccatacga

SEQ ID NO: 227 - DNA (other nucleic acid), 30 bp; single-stranded, linear
  description: /desc = "probe used for isolation of clone p131jh."
cgatgaaggttggggtaaacactccggcct

SEQ ID NO: 228 - DNA (other nucleic acid), 38 bp; single-stranded, linear
  description: /desc = "linker"
gatcctggaattctgataagaccttaagactattttaa

SEQ ID NO: 229 - DNA (other nucleic acid), 44 bp; single-stranded, linear
  description: /desc = "adaptor in an expression cassette."
aatttgggaattccataatgagacccttaaggtattactcagct

SEQ ID NO: 230 - protein, 5 aa
NLGIR

SEQ ID NO: 231 - DNA (other nucleic acid), 19 bp; single-stranded, linear
  description: /desc = "synthetic linkers"
gatcctgaattcctgataa

SEQ ID NO: 232 - DNA (other nucleic acid), 19 bp; single-stranded, linear
  description: /desc = "synthetic linker"
gacttaaggactattttaa

SEQ ID NO: 233 - DNA (other nucleic acid), 19 bp; single-stranded, linear
  description: /desc = "synthetic linker"
gatccgaattctgtgataa

SEQ ID NO: 234 - DNA (other nucleic acid), 19 bp; single-stranded, linear
  description: /desc = "synthetic linker"
gcttaagacactattttaa

SEQ ID NO: 235 - DNA (other nucleic acid), 19 bp; single-stranded, linear
  description: /desc = "synthetic linker"
gatcctggaattctgataa

SEQ ID NO: 236 - DNA (other nucleic acid), 19 bp; single-stranded, linear
  description: /desc = "synthetic linker"
gaccttaagactattttaa

SEQ ID NO: 237 - DNA (other nucleic acid), 38 bp; single-stranded, linear
  description: /desc = "adaptor for expression cassette"
attttgaattcctaatgagacttaaggattactcagct

SEQ ID NO: 238 - DNA (other nucleic acid), 38 bp; single-stranded, linear
  description: /desc = "adaptor for expression cassette"
aatttggaattctaatgagaccttaagattactcagct

SEQ ID NO: 239 - DNA (other nucleic acid), 24 bp; single-stranded, linear
  description: /desc = "linker for vector pS3-34."
aatttggaattctaattaattaag

SEQ ID NO: 240 - DNA (other nucleic acid), 24 bp; single-stranded, linear
  description: /desc = "linker for vector pS3-34"
accttaagattaattaattcagct

SEQ ID NO: 241 - DNA (other nucleic acid), 56 bp; single-stranded, linear
  description: /desc = "PCR primer"
gagtgctcaagcttcaaaacaaaatggctcactttctatcccagacaaagcagagt

SEQ ID NO: 242 - DNA (other nucleic acid), 50 bp; single-stranded, linear
  description: /desc = "PCR primer"
gagtgctcgtcgactcattagggggaaacatggttcccccgggaggcgaa

SEQ ID NO: 243 - DNA (other nucleic acid), 59 bp; single-stranded, linear
  description: /desc = "PCR primer"
gagtgctcaagcttcaaaacaaaatggggctctaccacgtcaccaatgattgccctaac

SEQ ID NO: 244 - DNA (other nucleic acid), 53 bp; single-stranded, linear
  description: /desc = "PCR primer"
gagtgctcgtcgactcattaaggggaccagttcatcatcatatcccatgccat

SEQ ID NO: 245 - DNA (other nucleic acid), 53 bp; single-stranded, linear
  description: /desc = "PCR primer"
gagtgcagcttcaaaacaaaatgagcacgaatcctaaacctcaaaaaaaaaac

SEQ ID NO: 246 - DNA (other nucleic acid), 53 bp; single-stranded, linear
  description: /desc = "PCR primer"
gagtgctcgtcgactcattaacccaaattgcgcgacctacgccgggggtctgt

SEQ ID NO: 247 - DNA (other nucleic acid), 60 bp; single-stranded, linear
  description: /desc = "PCR primer"
gagtgctcaagcttacaaaacaaaatggcaccaggcgccaagcagaacgtccagctgatc

SEQ ID NO: 248 - DNA (other nucleic acid), 59 bp; single-stranded, linear
  description: /desc = "PCR primer"
gagtgctcctcgaggtcgactcattactcggacctgtccctatcttccagatcgcaacg

SEQ ID NO: 249 - DNA (other nucleic acid), 45 bp; single-stranded, linear
  description: /desc = "PCR primer"
ggatccgctagcggcgccaagcagaacgtccagctgatcaacacc

SEQ ID NO: 250 - DNA (other nucleic acid), 48 bp; single-stranded, linear
  description: /desc = "PCR primer"
ggatccaagcttttactcggacctgtccctatcttccagatcgcaacg

SEQ ID NO: 251 - protein, 8 aa
KEPGGGQA

SEQ ID NO: 252 - protein, 8 aa
EPGGGQAV

SEQ ID NO: 253 - protein, 8 aa
PGGGQAVG

SEQ ID NO: 254 - protein, 8 aa
GGGQAVGG

SEQ ID NO: 255 - protein, 8 aa
GGQAVGGV

SEQ ID NO: 256 - protein, 8 aa
GQAVGGVY

SEQ ID NO: 257 - protein, 8 aa
QAVGGVYL

SEQ ID NO: 258 - protein, 8 aa
AVGGVYLL

SEQ ID NO: 259 - protein, 8 aa
VGGVYLLP

SEQ ID NO: 260 - protein, 8 aa
GGVYLLPR

SEQ ID NO: 261 - protein, 8 aa
GVYLLPRR

SEQ ID NO: 262 - protein, 8 aa
VYLLPRRG

SEQ ID NO: 263 - protein, 8 aa
YLLPRRGP

SEQ ID NO: 264 - protein, 8 aa
LLPRRGPR

SEQ ID NO: 265 - protein, 8 aa
PKARRPEG

SEQ ID NO: 266 - protein, 8 aa
KARRPEGR

SEQ ID NO: 267 - protein, 8 aa
ARRPEGRT

SEQ ID NO: 268 - protein, 8 aa
RRPEGRTW

SEQ ID NO: 269 - protein, 8 aa
RPEGRTWA

SEQ ID NO: 270 - protein, 8 aa
PEGRTWAQ

SEQ ID NO: 271 - protein, 8 aa
EGRTWAQP

SEQ ID NO: 272 - protein, 8 aa
GRTWAQPG

SEQ ID NO: 273 - protein, 8 aa
RTWAQPGY

SEQ ID NO: 274 - protein, 8 aa
TWAQPGYP

SEQ ID NO: 275 - protein, 8 aa
WAQPGYPW

SEQ ID NO: 276 - protein, 8 aa
AQPGYPWP

SEQ ID NO: 277 - protein, 8 aa
QPGYPWPL

SEQ ID NO: 278 - protein, 8 aa
PGYPWPLG

SEQ ID NO: 279 - protein, 8 aa
GYPWPLYG

SEQ ID NO: 280 - protein, 8 aa
YPWPLYGN

SEQ ID NO: 281 - protein, 8 aa
PWPLYGNE

SEQ ID NO: 282 - protein, 8 aa
WPLYGNEG

SEQ ID NO: 283 - protein, 8 aa
PLYGNEGC

SEQ ID NO: 284 - protein, 8 aa
LYGNEGCG

SEQ ID NO: 285 - protein, 8 aa
YGNEGCGW

SEQ ID NO: 286 - protein, 8 aa
GNEGCGWA

SEQ ID NO: 287 - protein, 8 aa
NEGCGWAG

SEQ ID NO: 288 - protein, 8 aa
EGCGWAGW

SEQ ID NO: 289 - protein, 8 aa
GCGWAGWL

SEQ ID NO: 290 - protein, 8 aa
CGWAGWLL

SEQ ID NO: 291 - protein, 8 aa
GWAGWLLS

SEQ ID NO: 292 - protein, 8 aa
WAGWLLSP

SEQ ID NO: 293 - protein, 8 aa
AGWLLSPR

SEQ ID NO: 294 - protein, 8 aa
GWLLSPRG

SEQ ID NO: 295 - protein, 8 aa
WLLSPRGS

SEQ ID NO: 296 - protein, 8 aa
LLSPRGSR

SEQ ID NO: 297 - protein, 8 aa
LSPRGSRP

SEQ ID NO: 298 - protein, 8 aa
SPRGSRPS

SEQ ID NO: 299 - protein, 8 aa
PRGSRPSW

SEQ ID NO: 300 - protein, 8 aa
RGSRPSWG

SEQ ID NO: 301 - protein, 8 aa
GSRPSWGP

SEQ ID NO: 302 - protein, 8 aa
SRPSWGPT

SEQ ID NO: 303 - protein, 8 aa
TVPASAYQ

SEQ ID NO: 304 - protein, 8 aa
VPASAYQV

SEQ ID NO: 305 - protein, 8 aa
PASAYQVR

SEQ ID NO: 306 - protein, 8 aa
ASAYQVRN

SEQ ID NO: 307 - protein, 8 aa
SAYQVRNS

SEQ ID NO: 308 - protein, 8 aa
AYQVRNST

SEQ ID NO: 309 - protein, 8 aa
DCPNSSIV

SEQ ID NO: 310 - protein, 8 aa
TPGCVPCV

SEQ ID NO: 311 - protein, 8 aa
EGNASRCW

SEQ ID NO: 312 - protein, 8 aa
TQLRRHID

SEQ ID NO: 313 - protein, 8 aa
LVGQLFTF

SEQ ID NO: 314 - protein, 8 aa
RHWTTQGC

SEQ ID NO: 315 - protein, 8 aa
HWTTQGCN

SEQ ID NO: 316 - protein, 8 aa
WTTQGCNC

SEQ ID NO: 317 - protein, 8 aa
MMMNWSPI

SEQ ID NO: 318 - protein, 8 aa
DMIAGAHW

SEQ ID NO: 319 - protein, 8 aa
LAGIAYFS

SEQ ID NO: 320 - protein, 8 aa
LINTNGSW

SEQ ID NO: 321 - protein, 8 aa
INTNGSWH

SEQ ID NO: 322 - protein, 8 aa
SLNTGWLA

SEQ ID NO: 323 - protein, 8 aa
FDQGWGPI

SEQ ID NO: 324 - protein, 8 aa
DQGWGPIS

SEQ ID NO: 325 - protein, 8 aa
QGWGPISY

SEQ ID NO: 326 - protein, 8 aa
GWGPISYA

SEQ ID NO: 327 - protein, 8 aa
WGPISYAN

SEQ ID NO: 328 - protein, 8 aa
GPISYANG

SEQ ID NO: 329 - protein, 8 aa
PISYANGS

SEQ ID NO: 330 - protein, 8 aa
PDQRPYCW

SEQ ID NO: 331 - protein, 8 aa
DQRPYCWH

SEQ ID NO: 332 - protein, 8 aa
QRPYCWHY

SEQ ID NO: 333 - protein, 8 aa
RPYCWHYP

SEQ ID NO: 334 - protein, 8 aa
PYCWHYPP

SEQ ID NO: 335 - protein, 8 aa
KSVCGPVY

SEQ ID NO: 336 - protein, 8 aa
SVCGPVYC

SEQ ID NO: 337 - protein, 8 aa
VCGPVYCE

SEQ ID NO: 338 - protein, 8 aa
RSGAPTYS

SEQ ID NO: 339 - protein, 8 aa
NNTRPPLG

SEQ ID NO: 340 - protein, 8 aa
NTRPPLGN

SEQ ID NO: 341 - protein, 8 aa
TRPPLGNW

SEQ ID NO: 342 - protein, 8 aa
RPPLGNWF

SEQ ID NO: 343 - protein, 8 aa
PPLGNWFG

SEQ ID NO: 344 - protein, 8 aa
PLGNWFGC

SEQ ID NO: 345 - protein, 8 aa
LGNWFGCT

SEQ ID NO: 346 - protein, 8 aa
GNWFGCTW

SEQ ID NO: 347 - protein, 8 aa
NWFGCTWM

SEQ ID NO: 348 - protein, 8 aa
WFGCTWMN

SEQ ID NO: 349 - protein, 8 aa
LHCPTDCF

SEQ ID NO: 350 - protein, 8 aa
YSRCGSGP

SEQ ID NO: 351 - protein, 8 aa
SRCGSGPW

SEQ ID NO: 352 - protein, 8 aa
RCGSGPWL

SEQ ID NO: 353 - protein, 8 aa
CGSGPWLT

SEQ ID NO: 354 - protein, 8 aa
GSGPWLTP

SEQ ID NO: 355 - protein, 8 aa
SGPWLTPR

SEQ ID NO: 356 - protein, 8 aa
GPWLTPRC

SEQ ID NO: 357 - protein, 8 aa
PWLTPRCL

SEQ ID NO: 358 - protein, 8 aa
WLTPRCLV

SEQ ID NO: 359 - protein, 8 aa
LTPRCLVD

SEQ ID NO: 360 - protein, 8 aa
TPRCLVDY

SEQ ID NO: 361 - protein, 8 aa
PRCLVDYP

SEQ ID NO: 362 - protein, 8 aa
RCLVDYPY

SEQ ID NO: 363 - protein, 8 aa
CLVDYPYR

SEQ ID NO: 364 - protein, 8 aa
LVDYPYRL

SEQ ID NO: 365 - protein, 8 aa
VDYPYRLW

SEQ ID NO: 366 - protein, 8 aa
DYPYRLWH

SEQ ID NO: 367 - protein, 8 aa
YPYRLWHY

SEQ ID NO: 368 - protein, 8 aa
PYRLWHYP

SEQ ID NO: 369 - protein, 8 aa
YRLWHYPC

SEQ ID NO: 370 - protein, 8 aa
EAACNWTR

SEQ ID NO: 371 - protein, 8 aa
LSPLLLII

SEQ ID NO: 372 - protein, 8 aa
SPLLLIII

SEQ ID NO: 373 - protein, 8 aa
PLLLIIIQ

SEQ ID NO: 374 - protein, 8 aa
LLLIIIQW

SEQ ID NO: 375 - protein, 8 aa
LSTGLIHL

SEQ ID NO: 376 - protein, 8 aa
VGSSIASW

SEQ ID NO: 377 - protein, 8 aa
GSSIASWA

SEQ ID NO: 378 - protein, 8 aa
ARVCSCIW

SEQ ID NO: 379 - protein, 8 aa
WVPGAVYT

SEQ ID NO: 380 - protein, 8 aa
VPGAVYTF

SEQ ID NO: 381 - protein, 8 aa
PGAVYTFY

SEQ ID NO: 382 - protein, 8 aa
GAVYTFYG

SEQ ID NO: 383 - protein, 8 aa
AVYTFYGM

SEQ ID NO: 384 - protein, 8 aa
VYTFYGMW

SEQ ID NO: 385 - protein, 8 aa
YTFYGMWP

SEQ ID NO: 386 - protein, 8 aa
TFYGMWPL

SEQ ID NO: 387 - protein, 8 aa
LALPQRAY

SEQ ID NO: 388 - protein, 8 aa
RVEAQLHV

SEQ ID NO: 389 - protein, 8 aa
VEAQLHVW

SEQ ID NO: 390 - protein, 8 aa
EAQLHVWI

SEQ ID NO: 391 - protein, 8 aa
AQLHVWIP

SEQ ID NO: 392 - protein, 8 aa
QLHVWIPP

SEQ ID NO: 393 - protein, 8 aa
LAVFGPLW

SEQ ID NO: 394 - protein, 8 aa
QGLLRFCA

SEQ ID NO: 395 - protein, 8 aa
MIGGHYVQ

SEQ ID NO: 396 - protein, 8 aa
TGTYVYNH

SEQ ID NO: 397 - protein, 8 aa
NHLTPLRD

SEQ ID NO: 398 - protein, 8 aa
HLTPLRDW

SEQ ID NO: 399 - protein, 8 aa
LTPLRDWA

SEQ ID NO: 400 - protein, 8 aa
LAPITAYA

SEQ ID NO: 401 - protein, 8 aa
TCINGVCW

SEQ ID NO: 402 - protein, 8 aa
LVGWPAPQ

SEQ ID NO: 403 - protein, 8 aa
CPAGHAVG

SEQ ID NO: 404 - protein, 8 aa
PAGHAVGI

SEQ ID NO: 405 - protein, 8 aa
AGHAVGIF

SEQ ID NO: 406 - protein, 8 aa
GHAVGIFR

SEQ ID NO: 407 - protein, 8 aa
HAVGIFRA

SEQ ID NO: 408 - protein, 8 aa
AVGIFRAA

SEQ ID NO: 409 - protein, 8 aa
VVPQSEQV

SEQ ID NO: 410 - protein, 8 aa
VPAAYAAQ

SEQ ID NO: 411 - protein, 8 aa
ATLGFGAY

SEQ ID NO: 412 - protein, 8 aa
GVRITTGS

SEQ ID NO: 413 - protein, 8 aa
VRITTGSP

SEQ ID NO: 414 - protein, 8 aa
RITTGSPI

SEQ ID NO: 415 - protein, 8 aa
ITTGSPIT

SEQ ID NO: 416 - protein, 8 aa
TTGSPITY

SEQ ID NO: 417 - protein, 8 aa
TGSPITYG

SEQ ID NO: 418 - protein, 7 aa
DATSILG

SEQ ID NO: 419 - protein, 8 aa
TAGARLVV

SEQ ID NO: 420 - protein, 8 aa
GEIPFYGK

SEQ ID NO: 421 - protein, 8 aa
VIKGGRHL

SEQ ID NO: 422 - protein, 8 aa
LGINAVAY

SEQ ID NO: 423 - protein, 8 aa
GINAVAYY

SEQ ID NO: 424 - protein, 8 aa
CNTCVIQT

SEQ ID NO: 425 - protein, 8 aa
GRGKPGIY

SEQ ID NO: 426 - protein, 8 aa
RGKPGIYR

SEQ ID NO: 427 - protein, 8 aa
PAETTVRL

SEQ ID NO: 428 - protein, 8 aa
AETTVRLR

SEQ ID NO: 429 - protein, 8 aa
ETTVRLRA

SEQ ID NO: 430 - protein, 8 aa
TTVRLRAY

SEQ ID NO: 431 - protein, 8 aa
GVFIGLIH

SEQ ID NO: 432 - protein, 8 aa
VFIGLIHI

SEQ ID NO: 433 - protein, 8 aa
ENLPYLVA

SEQ ID NO: 434 - protein, 8 aa
NLPYLVAY

SEQ ID NO: 435 - protein, 8 aa
LPYLVAYQ

SEQ ID NO: 436 - protein, 8 aa
PYLVAYQA

SEQ ID NO: 437 - protein, 8 aa
YLVAYQAT

SEQ ID NO: 438 - protein, 8 aa
LVAYQATV

SEQ ID NO: 439 - protein, 8 aa
VAYQATVC

SEQ ID NO: 440 - protein, 8 aa
AYQATVCA

SEQ ID NO: 441 - protein, 8 aa
YQATVCAR

SEQ ID NO: 442 - protein, 8 aa
QATVCARQ

SEQ ID NO: 443 - protein, 8 aa
ATVCARQA

SEQ ID NO: 444 - protein, 8 aa
TVCARQAP

SEQ ID NO: 445 - protein, 8 aa
PPSWDQMW

SEQ ID NO: 446 - protein, 8 aa
PSWDQMWK

SEQ ID NO: 447 - protein, 8 aa
SWDQMWKC

SEQ ID NO: 448 - protein, 8 aa
WDQMWKCL

SEQ ID NO: 449 - protein, 8 aa
DQMWKCLI

SEQ ID NO: 450 - protein, 8 aa
QMWKCLIR

SEQ ID NO: 451 - protein, 8 aa
MWKCLIRL

SEQ ID NO: 452 - protein, 8 aa
KPTLHGPI

SEQ ID NO: 453 - protein, 8 aa
PTLHGPIP

SEQ ID NO: 454 - protein, 8 aa
TLHGPIPL

SEQ ID NO: 455 - protein, 8 aa
LHGPIPLL

SEQ ID NO: 456 - protein, 8 aa
HGPIPLLY

SEQ ID NO: 457 - protein, 8 aa
GPIPLLYR

SEQ ID NO: 458 - protein, 8 aa
VVTSTWVL

SEQ ID NO: 459 - protein, 8 aa
IIPDREVL

SEQ ID NO: 460 - protein, 8 aa
IPDREVLY

SEQ ID NO: 461 - protein, 8 aa
ECSQHLPY

SEQ ID NO: 462 - protein, 8 aa
CSQHLPYI

SEQ ID NO: 463 - protein, 8 aa
SQHLPYIE

SEQ ID NO: 464 - protein, 8 aa
EKQKALGL

SEQ ID NO: 465 - protein, 8 aa
KQKALGLL

SEQ ID NO: 466 - protein, 8 aa
EIEWAKLM

SEQ ID NO: 467 - protein, 8 aa
IEWAKLMW

SEQ ID NO: 468 - protein, 8 aa
EWAKLMWN

SEQ ID NO: 469 - protein, 8 aa
WAKLMWNE

SEQ ID NO: 470 - protein, 8 aa
AKLMWNEI

SEQ ID NO: 471 - protein, 8 aa
LPGNPAIA

SEQ ID NO: 472 - protein, 8 aa
LFNILGGW

SEQ ID NO: 473 - protein, 8 aa
AAPGAATA

SEQ ID NO: 474 - protein, 8 aa
ILAGYGAG

SEQ ID NO: 475 - protein, 8 aa
VNLLPAIL

SEQ ID NO: 476 - protein, 8 aa
PGEGAVQW

SEQ ID NO: 477 - protein, 8 aa
GEGAVQWM

SEQ ID NO: 478 - protein, 8 aa
EGAVQWMN

SEQ ID NO: 479 - protein, 8 aa
GAVQWMNR

SEQ ID NO: 480 - protein, 8 aa
AVQWMNRL

SEQ ID NO: 481 - protein, 8 aa
VQWMNRLI

SEQ ID NO: 482 - protein, 8 aa
RGNHVSPI

SEQ ID NO: 483 - protein, 8 aa
AAARVTAI

SEQ ID NO: 484 - protein, 8 aa
AARVTAIL

SEQ ID NO: 485 - protein, 8 aa
ARVTAILS

SEQ ID NO: 486 - protein, 8 aa
RVTAILSS

SEQ ID NO: 487 - protein, 8 aa
VTAILSSL

SEQ ID NO: 488 - protein, 8 aa
TAILSSLV

SEQ ID NO: 489 - protein, 8 aa
AILSSLVT

SEQ ID NO: 490 - protein, 8 aa
ILSSLVTQ

SEQ ID NO: 491 - protein, 8 aa
LSSLVTQL

SEQ ID NO: 492 - protein, 8 aa
SSLVTQLL

SEQ ID NO: 493 - protein, 8 aa
SLVTQLLR

SEQ ID NO: 494 - protein, 8 aa
LVTQLLRR

SEQ ID NO: 495 - protein, 8 aa
SECTIPCS

SEQ ID NO: 496 - protein, 8 aa
ECTIPCSG

SEQ ID NO: 497 - protein, 8 aa
CTIPCSGS

SEQ ID NO: 498 - protein, 8 aa
TIPCSGSW

SEQ ID NO: 499 - protein, 8 aa
LMPQLPGI

SEQ ID NO: 500 - protein, 8 aa
MPQLPGIP

SEQ ID NO: 501 - protein, 8 aa
PQLPGIPE

SEQ ID NO: 502 - protein, 8 aa
QLPGIPEV

SEQ ID NO: 503 - protein, 8 aa
LPGIPEVS

SEQ ID NO: 504 - protein, 8 aa
PGIPEVSC

SEQ ID NO: 505 - protein, 8 aa
GIPEVSCQ

SEQ ID NO: 506 - protein, 8 aa
IPEVSCQR

SEQ ID NO: 507 - protein, 8 aa
PEVSCQRG

SEQ ID NO: 508 - protein, 8 aa
EVSCQRGY

SEQ ID NO: 509 - protein, 8 aa
VSCQRGYK

SEQ ID NO: 510 - protein, 8 aa
SCQRGYKG

SEQ ID NO: 511 - protein, 8 aa
CQRGYKGV

SEQ ID NO: 512 - protein, 8 aa
QRGYKGVW

SEQ ID NO: 513 - protein, 8 aa
RGYKGVWR

SEQ ID NO: 514 - protein, 8 aa
GYKGVWRG

SEQ ID NO: 515 - protein, 8 aa
IMHTRCHC

SEQ ID NO: 516 - protein, 8 aa
VGPRICRN

SEQ ID NO: 517 - protein, 8 aa
GPRICRNY

SEQ ID NO: 518 - protein, 8 aa
PRICRNYW

SEQ ID NO: 519 - protein, 8 aa
RICRNYWS

SEQ ID NO: 520 - protein, 8 aa
ICRNYWSG

SEQ ID NO: 521 - protein, 8 aa
CRNYWSGT

SEQ ID NO: 522 - protein, 8 aa
RNYWSGTE

SEQ ID NO: 523 - protein, 8 aa
NYWSGTEP

SEQ ID NO: 524 - protein, 8 aa
YWSGTEPI

SEQ ID NO: 525 - protein, 8 aa
WSGTEPIN

SEQ ID NO: 526 - protein, 8 aa
TPLPAPNY

SEQ ID NO: 527 - protein, 8 aa
EEYVIRQV

SEQ ID NO: 528 - protein, 8 aa
EYVIRQVG

SEQ ID NO: 529 - protein, 8 aa
YVIRQVGD

SEQ ID NO: 530 - protein, 8 aa
VIRQVGDF

SEQ ID NO: 531 - protein, 8 aa
IRQVGDFH

SEQ ID NO: 532 - protein, 8 aa
RQVGDFHY

SEQ ID NO: 533 - protein, 8 aa
DNLKCPCQ

SEQ ID NO: 534 - protein, 8 aa
EIELDGVR

SEQ ID NO: 535 - protein, 8 aa
IELDGVRL

SEQ ID NO: 536 - protein, 8 aa
ELDGVRLH

SEQ ID NO: 537 - protein, 8 aa
LDGVRLHR

SEQ ID NO: 538 - protein, 8 aa
DGVRLHRF

SEQ ID NO: 539 - protein, 8 aa
GVRLHRFA

SEQ ID NO: 540 - protein, 8 aa
VRLHRFAP

SEQ ID NO: 541 - protein, 8 aa
RLHRFAPP

SEQ ID NO: 542 - protein, 8 aa
LHRFAPPC

SEQ ID NO: 543 - protein, 8 aa
HRFAPPCK

SEQ ID NO: 544 - protein, 8 aa
RFAPPCKP

SEQ ID NO: 545 - protein, 8 aa
FAPPCKPL

SEQ ID NO: 546 - protein, 8 aa
APPCKPLL

SEQ ID NO: 547 - protein, 8 aa
PPCKPLLR

SEQ ID NO: 548 - protein, 8 aa
PCKPLLRE

SEQ ID NO: 549 - protein, 8 aa
CKPLLREE

SEQ ID NO: 550 - protein, 8 aa
KPLLREEV

SEQ ID NO: 551 - protein, 8 aa
PLLREEVS

SEQ ID NO: 552 - protein, 8 aa
LLREEVSF

SEQ ID NO: 553 - protein, 8 aa
LREEVSFR

SEQ ID NO: 554 - protein, 8 aa
REEVSFRV

SEQ ID NO: 555 - protein, 8 aa
EEVSFRVG

SEQ ID NO: 556 - protein, 8 aa
EVSFRVGL

SEQ ID NO: 557 - protein, 8 aa
VSFRVGLH

SEQ ID NO: 558 - protein, 8 aa
SFRVGLHE

SEQ ID NO: 559 - protein, 8 aa
FRVGLHEY

SEQ ID NO: 560 - protein, 8 aa
RVGLHEYP

SEQ ID NO: 561 - protein, 8 aa
EPEPDVAV

SEQ ID NO: 562 - protein, 8 aa
GRRLARGS

SEQ ID NO: 563 - protein, 8 aa
LIEANLLW

SEQ ID NO: 564 - protein, 8 aa
IEANLLWR

SEQ ID NO: 565 - protein, 8 aa
EANLLWRQ

SEQ ID NO: 566 - protein, 8 aa
ANLLWRQE

SEQ ID NO: 567 - protein, 8 aa
NLLWRQEM

SEQ ID NO: 568 - protein, 8 aa
LLWRQEMG

SEQ ID NO: 569 - protein, 8 aa
LWRQEMGG

SEQ ID NO: 570 - protein, 8 aa
VESENKVV

SEQ ID NO: 571 - protein, 8 aa
ESENKVVI

SEQ ID NO: 572 - protein, 8 aa
SENKVVIL

SEQ ID NO: 573 - protein, 8 aa
ENKVVILD

SEQ ID NO: 574 - protein, 8 aa
NKVVILDS

SEQ ID NO: 575 - protein, 8 aa
KVVILDSF

SEQ ID NO: 576 - protein, 8 aa
VVILDSFD

SEQ ID NO: 577 - protein, 8 aa
EISVPAEI

SEQ ID NO: 578 - protein, 8 aa
REAQALPV

SEQ ID NO: 579 - protein, 8 aa
EAQALPVW

SEQ ID NO: 580 - protein, 8 aa
AQALPVWA

SEQ ID NO: 581 - protein, 8 aa
QALPVWAR

SEQ ID NO: 582 - protein, 8 aa
ALPVWARP

SEQ ID NO: 583 - protein, 8 aa
LPVWARPD

SEQ ID NO: 584 - protein, 8 aa
PVWARPDY

SEQ ID NO: 585 - protein, 8 aa
VWARPDYN

SEQ ID NO: 586 - protein, 8 aa
WARPDYNP

SEQ ID NO: 587 - protein, 8 aa
ARPDYNPP

SEQ ID NO: 588 - protein, 8 aa
RPDYNPPL

SEQ ID NO: 589 - protein, 8 aa
PPPRKKRT

SEQ ID NO: 590 - protein, 8 aa
PPRKKRTV

SEQ ID NO: 591 - protein, 8 aa
PRKKRTVV

SEQ ID NO: 592 - protein, 8 aa
AELASRSE

SEQ ID NO: 593 - protein, 8 aa
ELASRSEG

SEQ ID NO: 594 - protein, 8 aa
LASRSEGS

SEQ ID NO: 595 - protein, 8 aa
ASRSEGSS

SEQ ID NO: 596 - protein, 8 aa
SRSEGSSS

SEQ ID NO: 597 - protein, 8 aa
AESYSSMP

SEQ ID NO: 598 - protein, 8 aa
SDGSWSTV

SEQ ID NO: 599 - protein, 8 aa
VVCCSMSY

SEQ ID NO: 600 - protein, 8 aa
VCCSMSYW

SEQ ID NO: 601 - protein, 8 aa
CCSMSYWI

SEQ ID NO: 602 - protein, 8 aa
CSMSYWIG

SEQ ID NO: 603 - protein, 8 aa
SMSYWIGA

SEQ ID NO: 604 - protein, 8 aa
MSYWIGAL

SEQ ID NO: 605 - protein, 8 aa
QKLPINAL

SEQ ID NO: 606 - protein, 8 aa
KLPINALS

SEQ ID NO: 607 - protein, 8 aa
LPINALSN

SEQ ID NO: 608 - protein, 8 aa
PINALSNS

SEQ ID NO: 609 - protein, 8 aa
INALSNSL

SEQ ID NO: 610 - protein, 8 aa
NALSNSLL

SEQ ID NO: 611 - protein, 8 aa
ALSNSLLR

SEQ ID NO: 612 - protein, 8 aa
LSNSLLRH

SEQ ID NO: 613 - protein, 8 aa
SNSLLRHH

SEQ ID NO: 614 - protein, 8 aa
NSLLRHHN

SEQ ID NO: 615 - protein, 8 aa
SLLRHHNL

SEQ ID NO: 616 - protein, 8 aa
LLRHHNLV

SEQ ID NO: 617 - protein, 8 aa
LRHHNLVY

SEQ ID NO: 618 - protein, 8 aa
RHHNLVYS

SEQ ID NO: 619 - protein, 8 aa
HHNLVYST

SEQ ID NO: 620 - protein, 8 aa
HNLVYSTI

SEQ ID NO: 621 - protein, 8 aa
NLVYSTIS

SEQ ID NO: 622 - protein, 8 aa
LVYSTISR

SEQ ID NO: 623 - protein, 8 aa
QKKVTFDR

SEQ ID NO: 624 - protein, 8 aa
KKVTFDRL

SEQ ID NO: 625 - protein, 8 aa
KVTFDRLQ

SEQ ID NO: 626 - protein, 8 aa
VTFDRLQV

SEQ ID NO: 627 - protein, 8 aa
TFDRLQVL

SEQ ID NO: 628 - protein, 8 aa
FDRLQVLD

SEQ ID NO: 629 - protein, 8 aa
DRLQVLDS

SEQ ID NO: 630 - protein, 8 aa
RLQVLDSH

SEQ ID NO: 631 - protein, 8 aa
ASKVKANL

SEQ ID NO: 632 - protein, 8 aa
RKAVTHIN

SEQ ID NO: 633 - protein, 8 aa
KAVTHINS

SEQ ID NO: 634 - protein, 8 aa
GRKPARLI

SEQ ID NO: 635 - protein, 8 aa
RKPARLIV

SEQ ID NO: 636 - protein, 8 aa
KPARLIVF

SEQ ID NO: 637 - protein, 8 aa
PARLIVFP

SEQ ID NO: 638 - protein, 8 aa
ARLIVFPD

SEQ ID NO: 639 - protein, 8 aa
RLIVFPDL

SEQ ID NO: 640 - protein, 8 aa
LPLAVMGS

SEQ ID NO: 641 - protein, 8 aa
PLAVMGSS

SEQ ID NO: 642 - protein, 8 aa
LAVMGSSY

SEQ ID NO: 643 - protein, 8 aa
AVMGSSYG

SEQ ID NO: 644 - protein, 8 aa
VMGSSYGE

SEQ ID NO: 645 - protein, 8 aa
MGSSYGEQ

SEQ ID NO: 646 - protein, 8 aa
GSSYGEQR

SEQ ID NO: 647 - protein, 8 aa
SSYGEQRV

SEQ ID NO: 648 - protein, 8 aa
SYGEQRVE

SEQ ID NO: 649 - protein, 8 aa
YGEQRVEE

SEQ ID NO: 650 - protein, 8 aa
GEQRVEEL

SEQ ID NO: 651 - protein, 8 aa
KTPMGFSY

SEQ ID NO: 652 - protein, 8 aa
TPMGFSYD

SEQ ID NO: 653 - protein, 8 aa
PMGFSYDT

SEQ ID NO: 654 - protein, 8 aa
MGFSYDTR

SEQ ID NO: 655 - protein, 8 aa
GFSYDTRC

SEQ ID NO: 656 - protein, 8 aa
FSYDTRCE

SEQ ID NO: 657 - protein, 8 aa
SYDTRCED

SEQ ID NO: 658 - protein, 8 aa
YQCCDLDP

SEQ ID NO: 659 - protein, 8 aa
LTERLYVG

SEQ ID NO: 660 - protein, 8 aa
TERLYVGG

SEQ ID NO: 661 - protein, 8 aa
ERLYVGGP

SEQ ID NO: 662 - protein, 8 aa
RLYVGGPL

SEQ ID NO: 663 - protein, 8 aa
NSRGENCG

SEQ ID NO: 664 - protein, 8 aa
SRGENCGY

SEQ ID NO: 665 - protein, 8 aa
RGENCGYR

SEQ ID NO: 666 - protein, 8 aa
GENCGYRR

SEQ ID NO: 667 - protein, 8 aa
ENCGYRRC

SEQ ID NO: 668 - protein, 8 aa
NCGYRRCR

SEQ ID NO: 669 - protein, 8 aa
TSCGNTLI

SEQ ID NO: 670 - protein, 8 aa
AACRAAGL

SEQ ID NO: 671 - protein, 8 aa
AFTEAMTR

SEQ ID NO: 672 - protein, 8 aa
FTEAMTRY

SEQ ID NO: 673 - protein, 8 aa
TEAMTRYS

SEQ ID NO: 674 - protein, 8 aa
EAMTRYSA

SEQ ID NO: 675 - protein, 8 aa
AMTRYSAP

SEQ ID NO: 676 - protein, 8 aa
MTRYSAPP

SEQ ID NO: 677 - protein, 8 aa
DLELIISC

SEQ ID NO: 678 - protein, 8 aa
LELIISCS

SEQ ID NO: 679 - protein, 8 aa
HDGAGKRV

SEQ ID NO: 680 - protein, 8 aa
DGAGKRVY

SEQ ID NO: 681 - protein, 8 aa
GAGKRVYY

SEQ ID NO: 682 - protein, 8 aa
AGKRVYYL

SEQ ID NO: 683 - protein, 8 aa
GKRVYYLT

SEQ ID NO: 684 - protein, 8 aa
KRVYYLTR

SEQ ID NO: 685 - protein, 8 aa
RVYYLTRD

SEQ ID NO: 686 - protein, 8 aa
VYYLTRDP

SEQ ID NO: 687 - protein, 8 aa
YYLTRDPT

SEQ ID NO: 688 - protein, 8 aa
WETARHTP

SEQ ID NO: 689 - protein, 8 aa
ETARHTPV

SEQ ID NO: 690 - protein, 8 aa
TARHTPVN

SEQ ID NO: 691 - protein, 8 aa
ARHTPVNS

SEQ ID NO: 692 - protein, 8 aa
RHTPVNSW

SEQ ID NO: 693 - protein, 8 aa
HTPVNSWL

SEQ ID NO: 694 - protein, 8 aa
TPVNSWLG

SEQ ID NO: 695 - protein, 8 aa
PVNSWLGN

SEQ ID NO: 696 - protein, 8 aa
VNSWLGNI

SEQ ID NO: 697 - protein, 8 aa
NSWLGNII

SEQ ID NO: 698 - protein, 8 aa
SWLGNIIM

SEQ ID NO: 699 - protein, 8 aa
WLGNIIME

SEQ ID NO: 700 - protein, 8 aa
LGNIIMEA

SEQ ID NO: 701 - protein, 8 aa
GNIIMEAP

SEQ ID NO: 702 - protein, 8 aa
NIIMEAPT

SEQ ID NO: 703 - protein, 8 aa
IIMEAPTL

SEQ ID NO: 704 - protein, 8 aa
IMEAPTLW

SEQ ID NO: 705 - protein, 8 aa
MEAPTLWA

SEQ ID NO: 706 - protein, 8 aa
EAPTLWAR

SEQ ID NO: 707 - protein, 8 aa
APTLWARM

SEQ ID NO: 708 - protein, 8 aa
PTLWARMI

SEQ ID NO: 709 - protein, 8 aa
TLWARMIL

SEQ ID NO: 710 - protein, 8 aa
LWARMILM

SEQ ID NO: 711 - protein, 8 aa
WARMILMT

SEQ ID NO: 712 - protein, 8 aa
ARMILMTH

SEQ ID NO: 713 - protein, 8 aa
RMILMTHF

SEQ ID NO: 714 - protein, 8 aa
MILMTHFE

SEQ ID NO: 715 - protein, 8 aa
LDCEIYGA

SEQ ID NO: 716 - protein, 8 aa
DCEIYGAC

SEQ ID NO: 717 - protein, 8 aa
CEIYGACY

SEQ ID NO: 718 - protein, 8 aa
EIYGACYS

SEQ ID NO: 719 - protein, 8 aa
IYGACYSI

SEQ ID NO: 720 - protein, 8 aa
DLPPIIQR

SEQ ID NO: 721 - protein, 8 aa
LPPIIQRL

SEQ ID NO: 722 - protein, 8 aa
PPIIQRLH

SEQ ID NO: 723 - protein, 8 aa
PIIQRLHG

SEQ ID NO: 724 - protein, 8 aa
IIQRLHGL

SEQ ID NO: 725 - protein, 8 aa
IQRLHGLS

SEQ ID NO: 726 - protein, 8 aa
QRLHGLSA

SEQ ID NO: 727 - protein, 8 aa
RLHGLSAF

SEQ ID NO: 728 - protein, 8 aa
LHGLSAFS

SEQ ID NO: 729 - protein, 8 aa
HGLSAFSL

SEQ ID NO: 730 - protein, 8 aa
GLSAFSLH

SEQ ID NO: 731 - protein, 8 aa
LSAFSLHS

SEQ ID NO: 732 - protein, 8 aa
SAFSLHSY

SEQ ID NO: 733 - protein, 8 aa
AFSLHSYS

SEQ ID NO: 734 - protein, 8 aa
FSLHSYSP

SEQ ID NO: 735 - protein, 8 aa
SLHSYSPG

SEQ ID NO: 736 - protein, 8 aa
LHSYSPGE

SEQ ID NO: 737 - protein, 8 aa
HSYSPGEI

SEQ ID NO: 738 - protein, 8 aa
LGVPPLRA

SEQ ID NO: 739 - protein, 8 aa
GVPPLRAW

SEQ ID NO: 740 - protein, 8 aa
VPPLRAWR

SEQ ID NO: 741 - protein, 8 aa
AAICGKYL

SEQ ID NO: 742 - protein, 8 aa
AICGKYLE

SEQ ID NO: 743 - protein, 8 aa
ICGKYLEN

SEQ ID NO: 744 - protein, 8 aa
DLSGWETA

SEQ ID NO: 745 - protein, 8 aa
VSHARPRW

SEQ ID NO: 746 - DNA (other nucleic acid), 16 bp; single-stranded, linear
  description: /desc = "primer derived from clone 81"
caatcatacctgacag

SEQ ID NO: 747 - DNA (other nucleic acid), 16 bp; single-stranded, linear
  description: /desc = "primer derived from clone 81"
gataacctctgcctga

SEQ ID NO: 748 - DNA (other nucleic acid), 16 bp; single-stranded, linear
  description: /desc = "primer from clone 36"
gcatgtcatgatgtat

SEQ ID NO: 749 - DNA (other nucleic acid), 16 bp; single-stranded, linear
  description: /desc = "primer from clone 37b"
acaatacgtgtgtcac

SEQ ID NO: 750 - DNA (other nucleic acid), 20 bp; single-stranded, linear
  description: /desc = "primer JHC 7"
ccagcggtggcctggtattg

SEQ ID NO: 751 - DNA (other nucleic acid), 30 bp; single-stranded, linear; identical to SEQ ID NO: 213
  description: /desc = "primer ALX 80"

SEQ ID NO: 752 - DNA (other nucleic acid), 27 bp; single-stranded, linear
  description: /desc = "primer JHC 6"
atatgcggccgccttccgttggcataa

SEQ ID NO: 753 - DNA (other nucleic acid), 54 bp; single-stranded, linear
  description: /desc = "primer JHC 13"
aattcgcggccgccatacgatttaggtgacactatagaaccccccccccccccc

SEQ ID NO: 754 - DNA (other nucleic acid), 16 bp; single-stranded, linear
  description: /desc = "primer 156e16B -  derived from clone 156e"
cgacaagaaagacaga

SEQ ID NO: 755 - DNA (other nucleic acid), 16 bp; single-stranded, linear
  description: /desc = "primer K91/16B - derived from clone K91"
cgttggcataactgat

SEQ ID NO: 756 - DNA (other nucleic acid), 16 bp; single-stranded, linear
  description: /desc = "sense strand primer ag30a16A"
ctctatggcaatgagg

SEQ ID NO: 757 - DNA (other nucleic acid), 16 bp; single-stranded, linear
  description: /desc = "sense strand primer 156e16A"
agcttcgacgtcacat

SEQ ID NO: 758 - DNA (other nucleic acid), 41 bp; single-stranded, linear
  description: /desc = "primer 202aEnv41a"
cttgaattcgcaatttgggtaaggtcatcgatacccttacg

SEQ ID NO: 759 - DNA (other nucleic acid), 38 bp; single-stranded, linear
  description: /desc = "primer 156e38B'"
cttgaattcgatagagcaattgcaaccttgcgtcgtcc

SEQ ID NO: 760 - DNA (other nucleic acid), 38 bp; single-stranded, linear
  description: /desc = "primer 156e38A'"
cttgaattcggacgacgcaaggttgcaattgctctatc

SEQ ID NO: 761 - DNA (other nucleic acid), 39 bp; single-stranded, linear
  description: /desc = "primer 59aEnv39C"
cttgaattccagccggtgttgaggctatcattgcagttc

SEQ ID NO: 762 - DNA (other nucleic acid), 16 bp; single-stranded, linear
  description: /desc = "primer CA216a16A - derived from clone 216"
tgaactatgcaacagg

SEQ ID NO: 763 - DNA (other nucleic acid), 16 bp; single-stranded, linear
  description: /desc = "primer CA216a16B - derived from clone 216"
ggagtgtgcaggatgg

SEQ ID NO: 764 - DNA (other nucleic acid), 16 bp; single-stranded, linear
  description: /desc = "primer CA84a16A - derived from clone 84"
aaggttgcaattgctc

SEQ ID NO: 765 - DNA (other nucleic acid), 16 bp; single-stranded, linear
  description: /desc = "primer CA84a16B"
actaacaggaccttcg

SEQ ID NO: 766 - DNA (other nucleic acid), 16 bp; single-stranded, linear
  description: /desc = "primer CA84a16C - derived from clone 84"
taacgggtcaccgcat

SEQ ID NO: 767 - protein, 16 aa
MNHSPVRNYCLHAESV

SEQ ID NO: 768 - protein, 4 aa
MALV

SEQ ID NO: 769 - protein, 15 aa
MSVVQPPGPPLPGEP

SEQ ID NO: 770 - protein, 12 aa
MPGDLGVPPQDC

SEQ ID NO: 771 - protein, 41 aa
IIPDREVLYREFDEMEECSQHLPYIEQMMLAEQFKQKALGL

SEQ ID NO: 772 - protein, 6 aa
DRGWGD

SEQ ID NO: 773 - protein, 13 aa
FDGDSYIFGDSYI

SEQ ID NO: 774 - protein, 5 aa
CCRSC

SEQ ID NO: 775 - DNA (other nucleic acid), 20 bp; single-stranded, linear
  description: /desc = "primer ssc5h20A - derived from clone 5h"
gtaatatggtgacagagtca

SEQ ID NO: 776 - DNA (other nucleic acid), 34 bp; single-stranded, linear
  description: /desc = "primer ssc5h34A - derived from clone 5h"
gatctctagagaaatcaatatggtgacagagtca

SEQ ID NO: 777 - DNA (other nucleic acid), 74 bp; single-stranded, linear
  description: /desc = "probe derived from clone 5h"
cccagcggcgtacgcgctggacacggaggtggccgcgtcgtgtggcggtgttgttctcgtcgggttgatggcgc

What is claimed is:

1. An octamer polypeptide immunoreactive with an HCV antibody, wherein the octamer has the amino acid sequence shown at positions 2280 to 2287 (AA2280–AA2287) as set forth in FIG. 72 (SEQ ID NOS:137–138).

2. An immunoassay reagent comprising a polypeptide according to claim 1.

3. A method for detecting the presence of antibodies immunoreactive within hepatitis C virus (HCV) proteins in a sample, said method comprising:
    contacting an immobilized immunoassay reagent according to claim 2 with said sample; and
    detecting antibodies bound to said reagent.

4. A method of making a polypeptide according to claim 1, wherein said polypeptide is prepared by recombinant expression or chemical synthesis.

5. A polypeptide immunoreactive with an HCV antibody wherein an immunoreactive portion reactive with said HCV antibody is a segment of an HCV polypeptide comprising amino acid 2244 to amino acid 2251 (AA2244–AA2251) as set forth in FIG. 72 (SEQ ID NOS:137–138), wherein said segment has a maximum length of approximately 25 amino acids.

6. The immunoreactive polypeptide according to claim 5 wherein said segment has a maximum length of approximately 20 amino acids.

7. An immunoassay reagent comprising a polypeptide according to any of claims 5–6.

8. A method for detecting the presence of antibodies immunoreactive within hepatitis C virus (HCV) proteins in a sample, said method comprising:
    contacting an immobilized immunoassay reagent according to claim 7 with said sample, and
    detecting antibodies bound to said reagent.

9. A method of making a polypeptide according to any of claims 5–6 wherein said polypeptide is prepared by recombinant expression or chemical synthesis.

* * * * *

UNITED STATES PATENT AND TRADEMARK OFFICE
CERTIFICATE OF CORRECTION

PATENT NO. : 6,346,375 B1
DATED : February 12, 2002
INVENTOR(S) : Chien

It is certified that error appears in the above-identified patent and that said Letters Patent is hereby corrected as shown below:

Column 94,
Line 4, please replace "GVRITTGS" with -- GVRTITTG --.
Line 6, please replace "VRITTGSP" with -- VRTITTGS --.
Line 8, please replace "RITTGSPI" with -- RTITTGSP --.
Line 28, please replace "LGWAVAY" with -- LGINAVAY --.
Line 30, please replace "GWAVAYY" with -- GINAVAYY --.

Column 95,
Line 43, please replace "EKQKALGL" with -- FKQKALGL --

Signed and Sealed this

Eighteenth Day of January, 2005

JON W. DUDAS
*Director of the United States Patent and Trademark Office*